United States Patent 11,596,686 (CORONAVIRUS VACCINE) - sequence listing, part 10

SEQ ID NO: 13033 - RNA, 4333 nt, synthetic construct
  misc_feature 1..4333: note = SARS-CoV-2/Wuhan/WIV05/2019__EPI_ISL_402128 spike protein mRNA gc mod (1-1211)(I712C_T1077C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13034 - RNA, 4333 nt, synthetic construct
  misc_feature 1..4333: note = SARS-CoV-2/Wuhan/WIV05/2019__EPI_ISL_402128 spike protein mRNA gc mod (1-1211)(I714C_Y1110C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13035 - RNA, 4333 nt, synthetic construct
  misc_feature 1..4333: note = SARS-CoV-2/Wuhan/WIV05/2019__EPI_ISL_402128 spike protein mRNA gc mod (1-1211)(P715C_P1069C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13036 - RNA, 4333 nt, synthetic construct
  misc_feature 1..4333: note = SARS-CoV-2/Wuhan/WIV05/2019__EPI_ISL_402128 spike protein mRNA gc mod (1-1211)(G889C_L1034C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13037 - RNA, 4333 nt, synthetic construct
  misc_feature 1..4333: note = SARS-CoV-2/Wuhan/WIV05/2019__EPI_ISL_402128 spike protein mRNA gc mod (1-1211)(I909C_Y1047C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13038 - RNA, 4333 nt, synthetic construct
  misc_feature 1..4333: note = SARS-CoV-2/Wuhan/WIV05/2019__EPI_ISL_402128 spike protein mRNA gc mod (1-1211)(Q965C_S1003C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13039 - RNA, 4333 nt, synthetic construct
  misc_feature 1..4333: note = SARS-CoV-2/Wuhan/WIV05/2019__EPI_ISL_402128 spike protein mRNA gc mod (1-1211)(F970C_G999C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13040 - RNA, 4333 nt, synthetic construct
  misc_feature 1..4333: note = SARS-CoV-2/Wuhan/WIV05/2019__EPI_ISL_402128 spike protein mRNA gc mod (1-1211)(A972C_R995C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13041 - RNA, 4333 nt, synthetic construct
  misc_feature 1..4333: note = SARS-CoV-2/Wuhan/WIV05/2019__EPI_ISL_402128 spike protein mRNA gc mod (1-1211)(A890C_V1040C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13042 - RNA, 4333 nt, synthetic construct
  misc_feature 1..4333: note = SARS-CoV-2/Wuhan/WIV05/2019__EPI_ISL_402128 spike protein mRNA gc mod (1-1211)(T874C_S1055C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13043 - RNA, 4357 nt, synthetic construct
  misc_feature 1..4357: note = SARS-CoV-2/Wuhan/WIV05/2019__EPI_ISL_402128 spike protein mRNA gc mod (1-1211) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13044 - RNA, 4357 nt, synthetic construct
  misc_feature 1..4357: note = SARS-CoV-2/Wuhan/WIV05/2019__EPI_ISL_402128 spike protein mRNA gc mod (1-1211)(K986P_V987P) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13045 - RNA, 4357 nt, synthetic construct
  misc_feature 1..4357: note = SARS-CoV-2/Wuhan/WIV05/2019__EPI_ISL_402128 spike protein mRNA gc mod (1-1211)(K986P_V987P_T887WN_A1020W) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13046 - RNA, 4357 nt, synthetic construct
  misc_feature 1..4357: note = SARS-CoV-2/Wuhan/WIV05/2019__EPI_ISL_402128 spike protein mRNA gc mod (1-1211)(K986P_V987P_P1069F) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13047 - RNA, 4357 nt, synthetic construct
  misc_feature 1..4357: note = SARS-CoV-2/Wuhan/WIV05/2019__EPI_ISL_402128 spike protein mRNA gc mod (1-1211)(K986P_V987P_ H1048Q_H1064N_ H1083N_H1101N) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13048 - RNA, 4357 nt, synthetic construct
  misc_feature 1..4357: note = SARS-CoV-2/Wuhan/WIV05/2019__EPI_ISL_402128 spike protein mRNA gc mod (1-1211)(I712C_T1077C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13049 - RNA, 4357 nt, synthetic construct
  misc_feature 1..4357: note = SARS-CoV-2/Wuhan/WIV05/2019__EPI_ISL_402128 spike protein mRNA gc mod (1-1211)(I714C_Y1110C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13050 - RNA, 4357 nt, synthetic construct
  misc_feature 1..4357: note = SARS-CoV-2/Wuhan/WIV05/2019__EPI_ISL_402128 spike protein mRNA gc mod (1-1211)(P715C_P1069C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13051 - RNA, 4357 nt, synthetic construct
  misc_feature 1..4357: note = SARS-CoV-2/Wuhan/WIV05/2019__EPI_ISL_402128 spike protein mRNA gc mod (1-1211)(G889C_L1034C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13052 - RNA, 4357 nt, synthetic construct
  misc_feature 1..4357: note = SARS-CoV-2/Wuhan/WIV05/2019__EPI_ISL_402128 spike protein mRNA gc mod (1-1211)(I909C_Y1047C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13053 - RNA, 4357 nt, synthetic construct
  misc_feature 1..4357: note = SARS-CoV-2/Wuhan/WIV05/2019__EPI_ISL_402128 spike protein mRNA gc mod (1-1211)(Q965C_S1003C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13054 - RNA, 4357 nt, synthetic construct
  misc_feature 1..4357: note = SARS-CoV-2/Wuhan/WIV05/2019__EPI_ISL_402128 spike protein mRNA gc mod (1-1211)(F970C_G999C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13055 - RNA, 4357 nt, synthetic construct
  misc_feature 1..4357: note = SARS-CoV-2/Wuhan/WIV05/2019__EPI_ISL_402128 spike protein mRNA gc mod (1-1211)(A972C_R995C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13056 - RNA, 4357 nt, synthetic construct
  misc_feature 1..4357: note = SARS-CoV-2/Wuhan/WIV05/2019__EPI_ISL_402128 spike protein mRNA gc mod (1-1211)(A890C_V1040C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13057 - RNA, 4357 nt, synthetic construct
  misc_feature 1..4357: note = SARS-CoV-2/Wuhan/WIV05/2019__EPI_ISL_402128 spike protein mRNA gc mod (1-1211)(T874C_S1055C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13058 - RNA, 3943 nt, synthetic construct
  misc_feature 1..3943: note = SARS-CoV-2/Wuhan/WIV05/2019__EPI_ISL_402128 spike protein mRNA gc mod (1-1211) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13059 - RNA, 3943 nt, synthetic construct
  misc_feature 1..3943: note = SARS-CoV-2/Wuhan/WIV05/2019__EPI_ISL_402128 spike protein mRNA gc mod (1-1211)(K986P_V987P) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13060 - RNA, 3943 nt, synthetic construct
  misc_feature 1..3943: note = SARS-CoV-2/Wuhan/WIV05/2019__EPI_ISL_402128 spike protein mRNA gc mod (1-1211)(K986P_V987P_T887WN_A1020W) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13061 - RNA, 3943 nt, synthetic construct
  misc_feature 1..3943: note = SARS-CoV-2/Wuhan/WIV05/2019__EPI_ISL_402128 spike protein mRNA gc mod (1-1211)(K986P_V987P_P1069F) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13062 - RNA, 3943 nt, synthetic construct
  misc_feature 1..3943: note = SARS-CoV-2/Wuhan/WIV05/2019__EPI_ISL_402128 spike protein mRNA gc mod (1-1211)(K986P_V987P_ H1048Q_H1064N_ H1083N_H1101N) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13063 - RNA, 3943 nt, synthetic construct
  misc_feature 1..3943: note = SARS-CoV-2/Wuhan/WIV05/2019__EPI_ISL_402128 spike protein mRNA gc mod (1-1211)(I712C_T1077C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13064 - RNA, 3943 nt, synthetic construct
  misc_feature 1..3943: note = SARS-CoV-2/Wuhan/WIV05/2019__EPI_ISL_402128 spike protein mRNA gc mod (1-1211)(I714C_Y1110C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13065 - RNA, 3943 nt, synthetic construct
  misc_feature 1..3943: note = SARS-CoV-2/Wuhan/WIV05/2019__EPI_ISL_402128 spike protein mRNA gc mod (1-1211)(P715C_P1069C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13066 - RNA, 3943 nt, synthetic construct
  misc_feature 1..3943: note = SARS-CoV-2/Wuhan/WIV05/2019__EPI_ISL_402128 spike protein mRNA gc mod (1-1211)(G889C_L1034C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13067 - RNA, 3943 nt, synthetic construct
  misc_feature 1..3943: note = SARS-CoV-2/Wuhan/WIV05/2019__EPI_ISL_402128 spike protein mRNA gc mod (1-1211)(I909C_Y1047C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13068 - RNA, 3943 nt, synthetic construct
  misc_feature 1..3943: note = SARS-CoV-2/Wuhan/WIV05/2019__EPI_ISL_402128 spike protein mRNA gc mod (1-1211)(Q965C_S1003C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13069 - RNA, 3943 nt, synthetic construct
  misc_feature 1..3943: note = SARS-CoV-2/Wuhan/WIV05/2019__EPI_ISL_402128 spike protein mRNA gc mod (1-1211)(F970C_G999C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13070 - RNA, 3943 nt, synthetic construct
  misc_feature 1..3943: note = SARS-CoV-2/Wuhan/WIV05/2019__EPI_ISL_402128 spike protein mRNA gc mod (1-1211)(A972C_R995C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13071 - RNA, 3943 nt, synthetic construct
  misc_feature 1..3943: note = SARS-CoV-2/Wuhan/WIV05/2019__EPI_ISL_402128 spike protein mRNA gc mod (1-1211)(A890C_V1040C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13072 - RNA, 3943 nt, synthetic construct
  misc_feature 1..3943: note = SARS-CoV-2/Wuhan/WIV05/2019__EPI_ISL_402128 spike protein mRNA gc mod (1-1211)(T874C_S1055C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13073 - RNA, 4315 nt, synthetic construct
  misc_feature 1..4315: note = SARS-CoV-2/Wuhan/WIV05/2019__EPI_ISL_402128 spike protein mRNA gc mod (1-1211) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13074 - RNA, 4315 nt, synthetic construct
  misc_feature 1..4315: note = SARS-CoV-2/Wuhan/WIV05/2019__EPI_ISL_402128 spike protein mRNA gc mod (1-1211)(K986P_V987P) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13075 - RNA, 4315 nt, synthetic construct
  misc_feature 1..4315: note = SARS-CoV-2/Wuhan/WIV05/2019__EPI_ISL_402128 spike protein mRNA gc mod (1-1211)(K986P_V987P_T887WN_A1020W) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13076 - RNA, 4315 nt, synthetic construct
  misc_feature 1..4315: note = SARS-CoV-2/Wuhan/WIV05/2019__EPI_ISL_402128 spike protein mRNA gc mod (1-1211)(K986P_V987P_P1069F) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13077 - RNA, 4315 nt, synthetic construct
  misc_feature 1..4315: note = SARS-CoV-2/Wuhan/WIV05/2019__EPI_ISL_402128 spike protein mRNA gc mod (1-1211)(K986P_V987P_ H1048Q_H1064N_ H1083N_H1101N) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13078 - RNA, 4315 nt, synthetic construct
  misc_feature 1..4315: note = SARS-CoV-2/Wuhan/WIV05/2019__EPI_ISL_402128 spike protein mRNA gc mod (1-1211)(I712C_T1077C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13079 - RNA, 4315 nt, synthetic construct
  misc_feature 1..4315: note = SARS-CoV-2/Wuhan/WIV05/2019__EPI_ISL_402128 spike protein mRNA gc mod (1-1211)(I714C_Y1110C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13080 - RNA, 4315 nt, synthetic construct
  misc_feature 1..4315: note = SARS-CoV-2/Wuhan/WIV05/2019__EPI_ISL_402128 spike protein mRNA gc mod (1-1211)(P715C_P1069C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13081 - RNA, 4315 nt, synthetic construct
  misc_feature 1..4315: note = SARS-CoV-2/Wuhan/WIV05/2019__EPI_ISL_402128 spike protein mRNA gc mod (1-1211)(G889C_L1034C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13082 - RNA, 4315 nt, synthetic construct
  misc_feature 1..4315: note = SARS-CoV-2/Wuhan/WIV05/2019__EPI_ISL_402128 spike protein mRNA gc mod (1-1211)(I909C_Y1047C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13083 - RNA, 4315 nt, synthetic construct
  misc_feature 1..4315: note = SARS-CoV-2/Wuhan/WIV05/2019__EPI_ISL_402128 spike protein mRNA gc mod (1-1211)(Q965C_S1003C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13084 - RNA, 4315 nt, synthetic construct
  misc_feature 1..4315: note = SARS-CoV-2/Wuhan/WIV05/2019__EPI_ISL_402128 spike protein mRNA gc mod (1-1211)(F970C_G999C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13085 - RNA, 4315 nt, synthetic construct
  misc_feature 1..4315: note = SARS-CoV-2/Wuhan/WIV05/2019__EPI_ISL_402128 spike protein mRNA gc mod (1-1211)(A972C_R995C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13086 - RNA, 4315 nt, synthetic construct
  misc_feature 1..4315: note = SARS-CoV-2/Wuhan/WIV05/2019__EPI_ISL_402128 spike protein mRNA gc mod (1-1211)(A890C_V1040C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13087 - RNA, 4315 nt, synthetic construct
  misc_feature 1..4315: note = SARS-CoV-2/Wuhan/WIV05/2019__EPI_ISL_402128 spike protein mRNA gc mod (1-1211)(T874C_S1055C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13088 - RNA, 4141 nt, synthetic construct
  misc_feature 1..4141: note = SARS-CoV-2/Wuhan/WIV05/2019__EPI_ISL_402128 spike protein mRNA gc mod (1-1147) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13089 - RNA, 4141 nt, synthetic construct
  misc_feature 1..4141: note = SARS-CoV-2/Wuhan/WIV05/2019__EPI_ISL_402128 spike protein mRNA gc mod (1-1147)(K986P_V987P) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13090 - RNA, 4141 nt, synthetic construct
  misc_feature 1..4141: note = SARS-CoV-2/Wuhan/WIV05/2019__EPI_ISL_402128 spike protein mRNA gc mod (1-1147)(K986P_V987P_T887WN_A1020W) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13091 - RNA, 4141 nt, synthetic construct
  misc_feature 1..4141: note = SARS-CoV-2/Wuhan/WIV05/2019__EPI_ISL_402128 spike protein mRNA gc mod (1-1147)(K986P_V987P_P1069F) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13092 - RNA, 4141 nt, synthetic construct
  misc_feature 1..4141: note = SARS-CoV-2/Wuhan/WIV05/2019__EPI_ISL_402128 spike protein mRNA gc mod (1-1147)(K986P_V987P_ H1048Q_H1064N_ H1083N_H1101N) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13093 - RNA, 4141 nt, synthetic construct
  misc_feature 1..4141: note = SARS-CoV-2/Wuhan/WIV05/2019__EPI_ISL_402128 spike protein mRNA gc mod (1-1147)(I712C_T1077C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13094 - RNA, 4141 nt, synthetic construct
  misc_feature 1..4141: note = SARS-CoV-2/Wuhan/WIV05/2019__EPI_ISL_402128 spike protein mRNA gc mod (1-1147)(I714C_Y1110C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13095 - RNA, 4141 nt, synthetic construct
  misc_feature 1..4141: note = SARS-CoV-2/Wuhan/WIV05/2019__EPI_ISL_402128 spike protein mRNA gc mod (1-1147)(P715C_P1069C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13096 - RNA, 4141 nt, synthetic construct
  misc_feature 1..4141: note = SARS-CoV-2/Wuhan/WIV05/2019__EPI_ISL_402128 spike protein mRNA gc mod (1-1147)(G889C_L1034C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13097 - RNA, 4141 nt, synthetic construct
  misc_feature 1..4141: note = SARS-CoV-2/Wuhan/WIV05/2019__EPI_ISL_402128 spike protein mRNA gc mod (1-1147)(I909C_Y1047C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13098 - RNA, 4141 nt, synthetic construct
  misc_feature 1..4141: note = SARS-CoV-2/Wuhan/WIV05/2019__EPI_ISL_402128 spike protein mRNA gc mod (1-1147)(Q965C_S1003C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13099 - RNA, 4141 nt, synthetic construct
  misc_feature 1..4141: note = SARS-CoV-2/Wuhan/WIV05/2019__EPI_ISL_402128 spike protein mRNA gc mod (1-1147)(F970C_G999C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13100 - RNA, 4141 nt, synthetic construct
  misc_feature 1..4141: note = SARS-CoV-2/Wuhan/WIV05/2019__EPI_ISL_402128 spike protein mRNA gc mod (1-1147)(A972C_R995C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13101 - RNA, 4141 nt, synthetic construct
  misc_feature 1..4141: note = SARS-CoV-2/Wuhan/WIV05/2019__EPI_ISL_402128 spike protein mRNA gc mod (1-1147)(A890C_V1040C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13102 - RNA, 4141 nt, synthetic construct
  misc_feature 1..4141: note = SARS-CoV-2/Wuhan/WIV05/2019__EPI_ISL_402128 spike protein mRNA gc mod (1-1147)(T874C_S1055C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13103 - RNA, 4165 nt, synthetic construct
  misc_feature 1..4165: note = SARS-CoV-2/Wuhan/WIV05/2019__EPI_ISL_402128 spike protein mRNA gc mod (1-1147) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13104 - RNA, 4165 nt, synthetic construct
  misc_feature 1..4165: note = SARS-CoV-2/Wuhan/WIV05/2019__EPI_ISL_402128 spike protein mRNA gc mod (1-1147)(K986P_V987P) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13105 - RNA, 4165 nt, synthetic construct
  misc_feature 1..4165: note = SARS-CoV-2/Wuhan/WIV05/2019__EPI_ISL_402128 spike protein mRNA gc mod (1-1147)(K986P_V987P_T887WN_A1020W) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13106 - RNA, 4165 nt, synthetic construct
  misc_feature 1..4165: note = SARS-CoV-2/Wuhan/WIV05/2019__EPI_ISL_402128 spike protein mRNA gc mod (1-1147)(K986P_V987P_P1069F) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13107 - RNA, 4165 nt, synthetic construct
  misc_feature 1..4165: note = SARS-CoV-2/Wuhan/WIV05/2019__EPI_ISL_402128 spike protein mRNA gc mod (1-1147)(K986P_V987P_ H1048Q_H1064N_ H1083N_H1101N) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13108 - RNA, 4165 nt, synthetic construct
  misc_feature 1..4165: note = SARS-CoV-2/Wuhan/WIV05/2019__EPI_ISL_402128 spike protein mRNA gc mod (1-1147)(I712C_T1077C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13109 - RNA, 4165 nt, synthetic construct
  misc_feature 1..4165: note = SARS-CoV-2/Wuhan/WIV05/2019__EPI_ISL_402128 spike protein mRNA gc mod (1-1147)(I714C_Y1110C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13110 - RNA, 4165 nt, synthetic construct
  misc_feature 1..4165: note = SARS-CoV-2/Wuhan/WIV05/2019__EPI_ISL_402128 spike protein mRNA gc mod (1-1147)(P715C_P1069C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13111 - RNA, 4165 nt, synthetic construct
  misc_feature 1..4165: note = SARS-CoV-2/Wuhan/WIV05/2019__EPI_ISL_402128 spike protein mRNA gc mod (1-1147)(G889C_L1034C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13112 - RNA, 4165 nt, synthetic construct
  misc_feature 1..4165: note = SARS-CoV-2/Wuhan/WIV05/2019__EPI_ISL_402128 spike protein mRNA gc mod (1-1147)(I909C_Y1047C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13113 - RNA, 4165 nt, synthetic construct
  misc_feature 1..4165: note = SARS-CoV-2/Wuhan/WIV05/2019__EPI_ISL_402128 spike protein mRNA gc mod (1-1147)(Q965C_S1003C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13114 - RNA, 4165 nt, synthetic construct
  misc_feature 1..4165: note = SARS-CoV-2/Wuhan/WIV05/2019__EPI_ISL_402128 spike protein mRNA gc mod (1-1147)(F970C_G999C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13115 - RNA, 4165 nt, synthetic construct
  misc_feature 1..4165: note = SARS-CoV-2/Wuhan/WIV05/2019__EPI_ISL_402128 spike protein mRNA gc mod (1-1147)(A972C_R995C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13116 - RNA, 4165 nt, synthetic construct
  misc_feature 1..4165: note = SARS-CoV-2/Wuhan/WIV05/2019__EPI_ISL_402128 spike protein mRNA gc mod (1-1147)(A890C_V1040C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13117 - RNA, 4165 nt, synthetic construct
  misc_feature 1..4165: note = SARS-CoV-2/Wuhan/WIV05/2019__EPI_ISL_402128 spike protein mRNA gc mod (1-1147)(T874C_S1055C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13118 - RNA, 3751 nt, synthetic construct
  misc_feature 1..3751: note = SARS-CoV-2/Wuhan/WIV05/2019__EPI_ISL_402128 spike protein mRNA gc mod (1-1147) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13119 - RNA, 3751 nt, synthetic construct
  misc_feature 1..3751: note = SARS-CoV-2/Wuhan/WIV05/2019__EPI_ISL_402128 spike protein mRNA gc mod (1-1147)(K986P_V987P) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13120 - RNA, 3751 nt, synthetic construct
  misc_feature 1..3751: note = SARS-CoV-2/Wuhan/WIV05/2019__EPI_ISL_402128 spike protein mRNA gc mod (1-1147)(K986P_V987P_T887WN_A1020W) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13121 - RNA, 3751 nt, synthetic construct
  misc_feature 1..3751: note = SARS-CoV-2/Wuhan/WIV05/2019__EPI_ISL_402128 spike protein mRNA gc mod (1-1147)(K986P_V987P_P1069F) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13122 - RNA, 3751 nt, synthetic construct
  misc_feature 1..3751: note = SARS-CoV-2/Wuhan/WIV05/2019__EPI_ISL_402128 spike protein mRNA gc mod (1-1147)(K986P_V987P_ H1048Q_H1064N_ H1083N_H1101N) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13123 - RNA, 3751 nt, synthetic construct
  misc_feature 1..3751: note = SARS-CoV-2/Wuhan/WIV05/2019__EPI_ISL_402128 spike protein mRNA gc mod (1-1147)(I712C_T1077C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13124 - RNA, 3751 nt, synthetic construct
  misc_feature 1..3751: note = SARS-CoV-2/Wuhan/WIV05/2019__EPI_ISL_402128 spike protein mRNA gc mod (1-1147)(I714C_Y1110C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13125 - RNA, 3751 nt, synthetic construct
  misc_feature 1..3751: note = SARS-CoV-2/Wuhan/WIV05/2019__EPI_ISL_402128 spike protein mRNA gc mod (1-1147)(P715C_P1069C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13126 - RNA, 3751 nt, synthetic construct
  misc_feature 1..3751: note = SARS-CoV-2/Wuhan/WIV05/2019__EPI_ISL_402128 spike protein mRNA gc mod (1-1147)(G889C_L1034C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13127 - RNA, 3751 nt, synthetic construct
  misc_feature 1..3751: note = SARS-CoV-2/Wuhan/WIV05/2019__EPI_ISL_402128 spike protein mRNA gc mod (1-1147)(I909C_Y1047C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13128 - RNA, 3751 nt, synthetic construct
  misc_feature 1..3751: note = SARS-CoV-2/Wuhan/WIV05/2019__EPI_ISL_402128 spike protein mRNA gc mod (1-1147)(Q965C_S1003C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13129 - RNA, 3751 nt, synthetic construct
  misc_feature 1..3751: note = SARS-CoV-2/Wuhan/WIV05/2019__EPI_ISL_402128 spike protein mRNA gc mod (1-1147)(F970C_G999C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13130 - RNA, 3751 nt, synthetic construct
  misc_feature 1..3751: note = SARS-CoV-2/Wuhan/WIV05/2019__EPI_ISL_402128 spike protein mRNA gc mod (1-1147)(A972C_R995C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13131 - RNA, 3751 nt, synthetic construct
  misc_feature 1..3751: note = SARS-CoV-2/Wuhan/WIV05/2019__EPI_ISL_402128 spike protein mRNA gc mod (1-1147)(A890C_V1040C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13132 - RNA, 3751 nt, synthetic construct
  misc_feature 1..3751: note = SARS-CoV-2/Wuhan/WIV05/2019__EPI_ISL_402128 spike protein mRNA gc mod (1-1147)(T874C_S1055C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13133 - RNA, 4123 nt, synthetic construct
  misc_feature 1..4123: note = SARS-CoV-2/Wuhan/WIV05/2019__EPI_ISL_402128 spike protein mRNA gc mod (1-1147) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13134 - RNA, 4123 nt, synthetic construct
  misc_feature 1..4123: note = SARS-CoV-2/Wuhan/WIV05/2019__EPI_ISL_402128 spike protein mRNA gc mod (1-1147)(K986P_V987P) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13135 - RNA, 4123 nt, synthetic construct
  misc_feature 1..4123: note = SARS-CoV-2/Wuhan/WIV05/2019__EPI_ISL_402128 spike protein mRNA gc mod (1-1147)(K986P_V987P_T887WN_A1020W) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggtggtttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagatggtctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13136 - RNA, 4123 nt, synthetic construct
  misc_feature 1..4123: note = SARS-CoV-2/Wuhan/WIV05/2019__EPI_ISL_402128 spike protein mRNA gc mod (1-1147)(K986P_V987P_P1069F) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgttcgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13137 - RNA, 4123 nt, synthetic construct
  misc_feature 1..4123: note = SARS-CoV-2/Wuhan/WIV05/2019__EPI_ISL_402128 spike protein mRNA gc mod (1-1147)(K986P_V987P_ H1048Q_H1064N_ H1083N_H1101N) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccagctgatgagcttccctcagtctgcccctcacggcgtggtgtttctgaacgtgacatatgtgcccgctcaagagaagaatttcaccaccgctccagccatctgcaacgacggcaaagcccactttcctagagaaggcgtgttcgtgtccaacggcaccaactggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13138 - RNA, 4123 nt, synthetic construct
  misc_feature 1..4123: note = SARS-CoV-2/Wuhan/WIV05/2019__EPI_ISL_402128 spike protein mRNA gc mod (1-1147)(I712C_T1077C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactcttgcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcacctgtgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13139 - RNA, 4123 nt, synthetic construct
  misc_feature 1..4123: note = SARS-CoV-2/Wuhan/WIV05/2019__EPI_ISL_402128 spike protein mRNA gc mod (1-1147)(I714C_Y1110C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgcttgccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctgtgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13140 - RNA, 4123 nt, synthetic construct
  misc_feature 1..4123: note = SARS-CoV-2/Wuhan/WIV05/2019__EPI_ISL_402128 spike protein mRNA gc mod (1-1147)(P715C_P1069C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatctgcaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgtgtgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13141 - RNA, 4123 nt, synthetic construct
  misc_feature 1..4123: note = SARS-CoV-2/Wuhan/WIV05/2019__EPI_ISL_402128 spike protein mRNA gc mod (1-1147)(G889C_L1034C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacattttgcgctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgtgtggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13142 - RNA, 4123 nt, synthetic construct
  misc_feature 1..4123: note = SARS-CoV-2/Wuhan/WIV05/2019__EPI_ISL_402128 spike protein mRNA gc mod (1-1147)(I909C_Y1047C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggctgcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctgtcacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13143 - RNA, 4123 nt, synthetic construct
  misc_feature 1..4123: note = SARS-CoV-2/Wuhan/WIV05/2019__EPI_ISL_402128 spike protein mRNA gc mod (1-1147)(Q965C_S1003C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagtgcctgtcctccaacttcggcgccatcagctctgtgctgaacgatatcctgagcagactggacaaggtcgaggccgaggtgcagatcgacagactgatcacaggcagactgcagtgtctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13144 - RNA, 4123 nt, synthetic construct
  misc_feature 1..4123: note = SARS-CoV-2/Wuhan/WIV05/2019__EPI_ISL_402128 spike protein mRNA gc mod (1-1147)(F970C_G999C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaactgcggcgccatcagctctgtgctgaacgatatcctgagcagactggacaaggtcgaggccgaggtgcagatcgacagactgatcacatgtagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13145 - RNA, 4123 nt, synthetic construct
  misc_feature 1..4123: note = SARS-CoV-2/Wuhan/WIV05/2019__EPI_ISL_402128 spike protein mRNA gc mod (1-1147)(A972C_R995C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggctgcatcagctctgtgctgaacgatatcctgagcagactggacaaggtcgaggccgaggtgcagatcgactgtctgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13146 - RNA, 4123 nt, synthetic construct
  misc_feature 1..4123: note = SARS-CoV-2/Wuhan/WIV05/2019__EPI_ISL_402128 spike protein mRNA gc mod (1-1147)(A890C_V1040C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggatgcggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagatgtgacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13147 - RNA, 4123 nt, synthetic construct
  misc_feature 1..4123: note = SARS-CoV-2/Wuhan/WIV05/2019__EPI_ISL_402128 spike protein mRNA gc mod (1-1147)(T874C_S1055C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtactgctctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtgcgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 13148-13151 - skipped (4 entries)

SEQ ID NO: 13152 - protein, 5 aa, synthetic construct
  REGION 1..5: note = Linker GGGGS
GGGGS

SEQ ID NO: 13153 - RNA, 15 nt, synthetic construct
  misc_feature 1..15: note = Linker GGGGS CDS gc
  source 1..15: mol_type = other RNA
ggcgggggcgggagc

SEQ ID NO: 13154 - RNA, 15 nt, synthetic construct
  misc_feature 1..15: note = Linker GGGGS CDS human
  source 1..15: mol_type = other RNA
ggcgggggaggtagc

SEQ ID NO: 13155 - RNA, 15 nt, synthetic construct
  misc_feature 1..15: note = Linker GGGGS CDS gc mod
  source 1..15: mol_type = other RNA
ggaggcggaggatct

SEQ ID NO: 13156 - RNA, 21 nt, synthetic construct
  misc_feature 1..21: note = Linker GGGSGGG CDS gc
  source 1..21: mol_type = other RNA
ggcggcgggagcgggggcggg

SEQ ID NO: 13157 - RNA, 21 nt, synthetic construct
  misc_feature 1..21: note = Linker GGGSGGG CDS human
  source 1..21: mol_type = other RNA
ggcgggggcagcgggggcggg

SEQ ID NO: 13158 - RNA, 21 nt, synthetic construct
  misc_feature 1..21: note = Linker GGGSGGG CDS gc mod
  source 1..21: mol_type = other RNA
ggcggaggatctggcggagga

SEQ ID NO: 13159 - RNA, 459 nt, synthetic construct
  misc_feature 1..459: note = Aa/VF5_ribH(C37A_N102D) Lumazine Synthase (LumSynth) CDS gc
  source 1..459: mol_type = other RNA
cagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgc

SEQ ID NO: 13160 - RNA, 459 nt, synthetic construct
  misc_feature 1..459: note = Aa/VF5_ribH(C37A_N102D) Lumazine Synthase (LumSynth) CDS gc
  source 1..459: mol_type = other RNA
cagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcgcgcaaggaggacatcgacgccgtcatcgccatcggggtgctgatccggggcgccacgccccacttcgactacatcgcgagcgaggtgtccaaggggctcgccgacctgagcctggagctccgcaagcccatcaccttcggcgtcatcaccgccgacaccctggagcaggccatcgagcgggccgggacgaagcacggcaacaagggctgggaggcggccctgtccgccatcgagatggccaacctcttcaagagcctgcgc

SEQ ID NO: 13161 - RNA, 459 nt, synthetic construct
  misc_feature 1..459: note = Aa/VF5_ribH(C37A_N102D) Lumazine Synthase (LumSynth) CDS human
  source 1..459: mol_type = other RNA
cagatctacgagggcaagctgaccgccgaagggctcagattcggaattgtggctagcaggtttaaccacgcacttgtcgaccggctggttgagggtgccatagatgcgatcgtgcgccatggcgggcgagaagaggacattacattggtacgtgtgcccggatcctgggaaatccctgtcgctgccggcgagttagcaagaaaagaggatattgacgccgtgatcgctataggtgttctgatcaggggagcaactccacacttcgattatattgcctctgaagtgtcaaaggggctagctgacctcagtctggagcttcggaaaccgatcacgtttggcgtcattaccgccgatacactggaacaagcgatcgagcgcgcaggcactaagcatgggaataaaggatgggaggccgctttgagcgccatagaaatggcaaacctcttcaagtccctgaga

SEQ ID NO: 13162 - RNA, 459 nt, synthetic construct
  misc_feature 1..459: note = Aa/VF5_ribH(C37A_N102D) Lumazine Synthase (LumSynth) CDS gc mod
  source 1..459: mol_type = other RNA
cagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcgg

SEQ ID NO: 13163 - RNA, 489 nt, synthetic construct
  misc_feature 1..489: note = Hp/J99_pfr(5-167_N19Q) Ferritin CDS gc
  source 1..489: mol_type = other RNA
gacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcc

SEQ ID NO: 13164 - RNA, 489 nt, synthetic construct
  misc_feature 1..489: note = Hp/J99_pfr(5-167_N19Q) Ferritin CDS gc
  source 1..489: mol_type = other RNA
gacatcatcaagctcctgaacgagcaggtgaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtccccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcc

SEQ ID NO: 13165 - RNA, 489 nt, synthetic construct
  misc_feature 1..489: note = Hp/J99_pfr(5-167_N19Q) Ferritin CDS gc
  source 1..489: mol_type = other RNA
gacatcatcaagctgctcaacgagcaggtcaacaaggagatgcagagctccaacctgtacatgagcatgtccagctggtgctacacccactccctggacggcgccggcctcttcctgttcgaccacgccgcggaggagtacgagcacgccaagaagctgatcatcttcctcaacgagaacaacgtgcccgtgcagctgaccagcatctccgccccggagcacaagttcgaggggctgacgcagatcttccagaaggcctacgagcacgagcagcacatcagcgagtccatcaacaacatcgtggaccacgccatcaagagcaaggaccacgcgaccttcaacttcctccagtggtacgtcgccgagcagcacgaggaggaggtgctgttcaaggacatcctggacaagatcgagctcatcgggaacgagaaccacggcctgtacctggccgaccagtacgtgaaggggatcgccaagtcccgcaagagc

SEQ ID NO: 13166 - RNA, 489 nt, synthetic construct
  misc_feature 1..489: note = Hp/J99_pfr(5-167_N19Q) Ferritin CDS human
  source 1..489: mol_type = other RNA
gacatcattaagctgctcaacgaacaggtgaataaagagatgcaaagctccaacctttacatgtctatgtcaagttggtgctatacccacagcctggatggcgccgggttgttcttatttgaccatgctgcagaggaatacgagcacgccaagaaactgataatcttcctaaatgaaaacaatgtccccgttcagctcacatccatttctgcgcctgagcataagtttgagggactgactcagatcttccagaaggcttatgaacacgagcaacatatttcggaatcaatcaacaatatagtggatcacgccatcaaaagcaaggaccacgcaacgtttaacttccttcagtggtacgtagccgagcagcatgaggaagaggtgctgtttaaagatattttggacaagatcgaactcattggtaatgagaaccacggcctgtatctggctgatcagtacgtcaaagggatcgcaaagagtagaaaatcc

SEQ ID NO: 13167 - RNA, 489 nt, synthetic construct
  misc_feature 1..489: note = Hp/J99_pfr(5-167_N19Q) Ferritin CDS gc mod
  source 1..489: mol_type = other RNA
gacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagc

SEQ ID NO: 13168 - RNA, 81 nt, synthetic construct
  misc_feature 1..81: note = BPT4_wac(458-484) Foldon CDS gc
  source 1..81: mol_type = other RNA
ggctacatccccgaggccccgcgcgacgggcaggcctacgtgcggaaggacggcgagtgggtcctgctcagcaccttcctg

SEQ ID NO: 13169 - RNA, 81 nt, synthetic construct
  misc_feature 1..81: note = BPT4_wac(458-484) Foldon CDS human
  source 1..81: mol_type = other RNA
ggctacatccccgaggcccctagagacgggcaggcttatgtgaggaaggatggagaatgggtcctgctcagcaccttcctt

SEQ ID NO: 13170 - RNA, 81 nt, synthetic construct
  misc_feature 1..81: note = BPT4_wac(458-484) Foldon CDS gc mod
  source 1..81: mol_type = other RNA
ggctatatccccgaggctcctagagatggccaggcctatgttcggaaggatggcgaatgggtgctgctgagcaccttcctt

SEQ ID NO: 13171 - protein, 149 aa, synthetic construct
  REGION 1..149: note = WHV_WhBvgp4(1-149_C150) WhcAg VLP
DIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13172 - RNA, 447 nt, synthetic construct
  misc_feature 1..447: note = WHV_WhBvgp4(1-149_C150) WhcAg VLP CDS gc
  source 1..447: mol_type = other RNA
gacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgc

SEQ ID NO: 13173 - RNA, 447 nt, synthetic construct
  misc_feature 1..447: note = WHV_WhBvgp4(1-149_C150) WhcAg VLP CDS gc
  source 1..447: mol_type = other RNA
gacatcgacccctacaaggagttcggcagctcctaccagctgctcaacttcctgccgctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtgaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgcccatcctctccaccctgcccgagcacaccgtgatctgc

SEQ ID NO: 13174 - RNA, 447 nt, synthetic construct
  misc_feature 1..447: note = WHV_WhBvgp4(1-149_C150) WhcAg VLP CDS human
  source 1..447: mol_type = other RNA
gacatcgatccctacaaggagttcggcagctcctatcagctgctcaactttcttcctctggacttctttccagatttgaatgccttagtggacaccgctacagcactgtacgaagaggaactaactgggagagagcactgctctccgcatcacacggccattaggcaagcgctcgtctgttgggatgaactgaccaaacttatagcttggatgtcaagtaacatcacaagcgagcaggttcggactattatcgtgaatcatgtaaacgacacctggggactgaaggtgcgccagtccttgtggttccacctctcttgcctgacatttggtcagcataccgtccaagagttcctggtgtcgtttggcgtttggattcgaactcccgccccttatcgtccacccaatgcacctatcctctcaacattaccagaacacaccgtgatatgt

SEQ ID NO: 13175 - RNA, 447 nt, synthetic construct
  misc_feature 1..447: note = WHV_WhBvgp4(1-149_C150) WhcAg VLP CDS gc mod
  source 1..447: mol_type = other RNA
gacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgt

SEQ ID NO: 13176 - protein, 126 aa, synthetic construct
  REGION 1..126: note = SARS-CoV-2/Wuhan/WIV05/2019__EPI_ISL_402128 spike protein (1148-1273)
FKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13177 - protein, 126 aa, synthetic construct
  REGION 1..126: note = SARS-CoV-2/bat/Yunnan/RaTG13/2013__EPI_ISL_402131 spike protein (1144-1269)
FKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 13178 - protein, 126 aa, synthetic construct; identical to SEQ ID NO: 13176
  REGION 1..126: note = SARS-CoV-2/Wuhan/HBCDC-HB-01/2019__EPI_ISL_402132 spike protein (1148-1273)

SEQ ID NO: 13179 - protein, 126 aa, synthetic construct; identical to SEQ ID NO: 13176
  REGION 1..126: note = SARS-CoV-2/Guangdong/20SF028/2020__EPI_ISL_403936 spike protein (1148-1273)

SEQ ID NO: 13180 - protein, 126 aa, synthetic construct
  REGION 1..126: note = SARS-CoV-2/Shenzhen/SZTH-001/2020__EPI_ISL_406592 spike protein (1148-1273)
FKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 13181 - protein, 126 aa, synthetic construct; identical to SEQ ID NO: 13176
  REGION 1..126: note = SARS-CoV-2/Shenzhen/SZTH-004/2020__EPI_ISL_406595 spike protein (1148-1273)

SEQ ID NO: 13182 - protein, 126 aa, synthetic construct; identical to SEQ ID NO: 13176
  REGION 1..126: note = SARS-CoV-2/France/IDF0372/2020__EPI_ISL_406596 spike protein (1148-1273)

SEQ ID NO: 13183 - protein, 126 aa, synthetic construct; identical to SEQ ID NO: 13176
  REGION 1..126: note = SARS-CoV-2/Australia/VIC01/2020__EPI_ISL_406844 spike protein (1148-1273)

SEQ ID NO: 13184 - protein, 126 aa, synthetic construct; identical to SEQ ID NO: 13176
  REGION 1..126: note = SARS-CoV-2/Germany/BavPat1/2020__EPI_ISL_406862 spike protein (1148-1273)

SEQ ID NO: 13185 - protein, 126 aa, synthetic construct; identical to SEQ ID NO: 13176
  REGION 1..126: note = SARS-CoV-2/Wuhan/HBCDC-HB-02/2020__EPI_ISL_412978 spike protein (1148-1273)

SEQ ID NO: 13186 - protein, 126 aa, synthetic construct; identical to SEQ ID NO: 13176
  REGION 1..126: note = SARS-CoV-2/Australia/QLD02/2020__EPI_ISL_407896 spike protein (1148-1273)

SEQ ID NO: 13187 - protein, 126 aa, synthetic construct; identical to SEQ ID NO: 13176
  REGION 1..126: note = SARS-CoV-2/India/1-31/2020__EPI_ISL_413523 spike protein (1148-1273)

SEQ ID NO: 13188 - protein, 126 aa, synthetic construct; identical to SEQ ID NO: 13176
  REGION 1..126: note SARS-CoV-2/Guangdong/GD2020087-P0008/2020__EPI_ISL_413863 spike protein (1148-1273)

SEQ ID NO: 13189 - protein, 126 aa, synthetic construct; identical to SEQ ID NO: 13176
  REGION 1..126: note = SARS-CoV-2/Sweden/01/2020__EPI_ISL_411951 spike protein (1148-1273)

SEQ ID NO: 13190 - protein, 126 aa, synthetic construct; identical to SEQ ID NO: 13176
  REGION 1..126: note = SARS-CoV-2/Tianmen/HBCDC-HB-07/2020__EPI_ISL_412983 spike protein (1148-1273)

SEQ ID NO: 13191 - protein, 126 aa, synthetic construct; identical to SEQ ID NO: 13176
  REGION 1..126: note = SARS-CoV-2/Hong Kong/case42_VM20002493/2020__EPI_ISL_414527 spike protein (1148-1273)

SEQ ID NO: 13192 - protein, 126 aa, synthetic construct; identical to SEQ ID NO: 13176
  REGION 1..126: note = SARS-CoV-2/USA/CruiseA-23/2020__EPI_ISL_414482 spike protein (1148-1273)

SEQ ID NO: 13193 - protein, 126 aa, synthetic construct; identical to SEQ ID NO: 13176
  REGION 1..126: note = SARS-CoV-2/Hong Kong/case85_VM20002868/2020__EPI_ISL_414519 spike protein (1148-1273)

SEQ ID NO: 13194 - protein, 126 aa, synthetic construct
  REGION 1..126: note = SARS-CoV-2/England/200990660/2020__EPI_ISL_414523 spike protein (1148-1273)
FKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 13195 - protein, 126 aa, synthetic construct; identical to SEQ ID NO: 13176
  REGION 1..126: note = SARS-CoV-2/Australia/NSW09/2020__EPI_ISL_413595 spike protein (1148-1273)

SEQ ID NO: 13196 - protein, 126 aa, synthetic construct
  REGION 1..126: note = SARS-CoV-2/Australia/NSW10/2020__EPI_ISL_413596 spike protein (1148-1273)
FKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 13197 - protein, 126 aa, synthetic construct; identical to SEQ ID NO: 13176
  REGION 1..126: note SARS-CoV-2/Switzerland/1000477797/2020__EPI_ISL_413023 spike protein (1148-1273)

SEQ ID NO: 13198 - protein, 126 aa, synthetic construct; identical to SEQ ID NO: 13176
  REGION 1..126: note = SARS-CoV-2/Belgium/BA-02291/2020__EPI_ISL_415159 spike protein (1148-1273)

SEQ ID NO: 13199 - protein, 126 aa, synthetic construct; identical to SEQ ID NO: 13176
  REGION 1..126: note = SARS-CoV-2/USA/WA8-UW5/2020__EPI_ISL_413486 spike protein (1148-1273)

SEQ ID NO: 13200 - protein, 126 aa, synthetic construct; identical to SEQ ID NO: 13176
  REGION 1..126: note = SARS-CoV-2/England/20102000506/2020__EPI_ISL_415147 spike protein (1148-1273)

SEQ ID NO: 13201 - protein, 126 aa, synthetic construct; identical to SEQ ID NO: 13176
  REGION 1..126: note = SARS-CoV-2/Belgium/VAG-03013/2020__EPI_ISL_415155 spike protein (1148-1273)

SEQ ID NO: 13202 - protein, 126 aa, synthetic construct; identical to SEQ ID NO: 13176
  REGION 1..126: note = SARS-CoV-2/Belgium/BC-03016/2020__EPI_ISL_415157 spike protein (1148-1273)

SEQ ID NO: 13203 - protein, 126 aa, synthetic construct; identical to SEQ ID NO: 13176
  REGION 1..126: note = SARS-CoV-2/Germany/BavPat3/2020__EPI_ISL_414521 spike protein (1148-1273)

SEQ ID NO: 13204 - protein, 126 aa, synthetic construct; identical to SEQ ID NO: 13176
  REGION 1..126: note = SARS-CoV-2/France/HF1805/2020__EPI_ISL_414628 spike protein (1148-1273)

SEQ ID NO: 13205 - protein, 126 aa, synthetic construct; identical to SEQ ID NO: 13176
  REGION 1..126: note SARS-CoV-2/Netherlands/ZuidHolland_9/2020__EPI_ISL_414445 spike protein (1148-1273)

SEQ ID NO: 13206 - protein, 126 aa, synthetic construct; identical to SEQ ID NO: 13176
  REGION 1..126: note = SARS-CoV-2/Finland/FIN03032020A/2020__EPI_ISL_413602 spike protein (1148-1273)

SEQ ID NO: 13207 - protein, 126 aa, synthetic construct; identical to SEQ ID NO: 13176
  REGION 1..126: note = SARS-CoV-2/France/GE1977/2020__EPI_ISL_414632 spike protein (1148-1273)

SEQ ID NO: 13208 - protein, 126 aa, synthetic construct; identical to SEQ ID NO: 13176
  REGION 1..126: note = SARS-CoV-2/Finland/FIN-313/2020__EPI_ISL_414641 spike protein (1148-1273)

SEQ ID NO: 13209 - protein, 126 aa, synthetic construct; identical to SEQ ID NO: 13176
  REGION 1..126: note SARS-CoV-2/Netherlands/ZuidHolland_2/2020__EPI_ISL_414556 spike protein (1148-1273)

SEQ ID NO: 13210 - protein, 126 aa, synthetic construct; identical to SEQ ID NO: 13176
  REGION 1..126: note = SARS-CoV-2/USA/WA-UW31/2020__EPI_ISL_414618 spike protein (1148-1273)

SEQ ID NO: 13211 - protein, 126 aa, synthetic construct; identical to SEQ ID NO: 13176
  REGION 1..126: note = SARS-CoV-2/South Korea/SNU01/2020__EPI_ISL_411929 spike protein (1148-1273)

SEQ ID NO: 13212 - protein, 126 aa, synthetic construct; identical to SEQ ID NO: 13176
  REGION 1..126: note = SARS-CoV-2/China/WF0004/2020__EPI_ISL_413694 spike protein (1148-1273)

SEQ ID NO: 13213 - protein, 126 aa, synthetic construct; identical to SEQ ID NO: 13176
  REGION 1..126: note = SARS-CoV-2/China/WF0028/2020__EPI_ISL_413791 spike protein (1148-1273)

SEQ ID NO: 13214 - protein, 126 aa, synthetic construct; identical to SEQ ID NO: 13176
  REGION 1..126: note = SARS-CoV-2/2019-nCoV/USA-CruiseA-18/2020__MT159716.1 spike protein (1148-1273)

SEQ ID NO: 13215 - protein, 126 aa, synthetic construct; identical to SEQ ID NO: 13176
  REGION 1..126: note SARS-CoV-2/SARS-CoV-2/Yunnan-01/human/2020/CHN__MT049951.1 spike protein (1148-1273)

SEQ ID NO: 13216 - protein, 126 aa, synthetic construct; identical to SEQ ID NO: 13176
  REGION 1..126: note = SARS-CoV-2/USA/WA-UW292/2020__EPI_ISL_418077 spike protein (1148-1273)

SEQ ID NO: 13217 - protein, 126 aa, synthetic construct; identical to SEQ ID NO: 13176
  REGION 1..126: note = SARS-CoV-2/Iceland/192/2020__EPI_ISL_417819 spike protein (1148-1273)

SEQ ID NO: 13218 - protein, 126 aa, synthetic construct; identical to SEQ ID NO: 13176
  REGION 1..126: note = SARS-CoV-2/Belgium/ULG-6939/2020__EPI_ISL_417020 spike protein (1148-1273)

SEQ ID NO: 13219 - protein, 126 aa, synthetic construct; identical to SEQ ID NO: 13176
  REGION 1..126: note = SARS-CoV-2/France/HF2496/2020__EPI_ISL_418231 spike protein (1148-1273)

SEQ ID NO: 13220 - protein, 126 aa, synthetic construct; identical to SEQ ID NO: 13176
  REGION 1..126: note = SARS-CoV-2/USA/WA-UW291/2020__EPI_ISL_418076 spike protein (1148-1273)

SEQ ID NO: 13221 - protein, 126 aa, synthetic construct
  REGION 1..126: note = SARS-CoV-2/Portugal/PT0034/2020__EPI_ISL_418019 spike protein (1148-1273)
FKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 13222 - protein, 126 aa, synthetic construct
  REGION 1..126: note = SARS-CoV-2/Iceland/202/2020__EPI_ISL_417750 spike protein (1148-1273)
FKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13223 - protein, 126 aa, synthetic construct; identical to SEQ ID NO: 13176
  REGION 1..126: note = SARS-CoV-2/USA/WA-UW261/2020__EPI_ISL_418046 spike protein (1148-1273)

SEQ ID NO: 13224 - protein, 126 aa, synthetic construct; identical to SEQ ID NO: 13176
  REGION 1..126: note = SARS-CoV-2/Portugal/PT0035/2020__EPI_ISL_418020 spike protein (1148-1273)

SEQ ID NO: 13225 - protein, 126 aa, synthetic construct; identical to SEQ ID NO: 13176
  REGION 1..126: note = SARS-CoV-2/USA/NY-NYUMC7/2020__EPI_ISL_418192 spike protein (1148-1273)

SEQ ID NO: 13226 - protein, 126 aa, synthetic construct; identical to SEQ ID NO: 13176
  REGION 1..126: note = SARS-CoV-2/Iceland/189/2020__EPI_ISL_417709 spike protein (1148-1273)

SEQ ID NO: 13227 - protein, 126 aa, synthetic construct; identical to SEQ ID NO: 13176
  REGION 1..126: note = SARS-CoV-2/Australia/NSW56/2020__EPI_ISL_417408 spike protein (1148-1273)

SEQ ID NO: 13228 - protein, 126 aa, synthetic construct; identical to SEQ ID NO: 13176
  REGION 1..126: note = SARS-CoV-2/Iceland/280/2020__EPI_ISL_417608 spike protein (1148-1273)

SEQ ID NO: 13229 - protein, 126 aa, synthetic construct
  REGION 1..126: note = SARS-CoV-2/Iceland/247/2020__EPI_ISL_417575 spike protein (1148-1273)
FKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 13230 - protein, 126 aa, synthetic construct; identical to SEQ ID NO: 13176
  REGION 1..126: note = SARS-CoV-2/Iceland/238/2020__EPI_ISL_417566 spike protein (1148-1273)

SEQ ID NO: 13231 - protein, 126 aa, synthetic construct; identical to SEQ ID NO: 13176
  REGION 1..126: note = SARS-CoV-2/Greece/16/2020__EPI_ISL_418265 spike protein (1148-1273)

SEQ ID NO: 13232 - protein, 126 aa, synthetic construct; identical to SEQ ID NO: 13176
  REGION 1..126: note = SARS-CoV-2/Iceland/319/2020__EPI_ISL_417648 spike protein (1148-1273)

SEQ ID NO: 13233 - protein, 126 aa, synthetic construct; identical to SEQ ID NO: 13176
  REGION 1..126: note = SARS-CoV-2/Congo/94/2020__EPI_ISL_417947 spike protein (1148-1273)

SEQ ID NO: 13234 - protein, 126 aa, synthetic construct; identical to SEQ ID NO: 13176
  REGION 1..126: note = SARS-CoV-2/Congo/158/2020__EPI_ISL_417950 spike protein (1148-1273)

SEQ ID NO: 13235 - protein, 126 aa, synthetic construct; identical to SEQ ID NO: 13176
  REGION 1..126: note = SARS-CoV-2/USA/UT-00034/2020__EPI_ISL_417977 spike protein (1148-1273)

SEQ ID NO: 13236 - protein, 126 aa, synthetic construct; identical to SEQ ID NO: 13176
  REGION 1..126: note = SARS-CoV-2/USA/UT-00033/2020__EPI_ISL_417976 spike protein (1148-1273)

SEQ ID NO: 13237 - protein, 126 aa, synthetic construct; identical to SEQ ID NO: 13176
  REGION 1..126: note = SARS-CoV-2/USA/WI-13/2020__EPI_ISL_417516 spike protein (1148-1273)

SEQ ID NO: 13238 - protein, 126 aa, synthetic construct; identical to SEQ ID NO: 13176
  REGION 1..126: note = SARS-CoV-2/India/1-27/2020__EPI_ISL_413522 spike protein (1147-1272)

SEQ ID NO: 13239 - protein, 126 aa, synthetic construct
  REGION 1..126: note = SARS-CoV-2/pangolin/Guangxi/P4L/2017__EPI_ISL_410538 spike protein (1142-1267)
FKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 13240 - protein, 126 aa, synthetic construct; identical to SEQ ID NO: 13177
  REGION 1..126: note = SARS-CoV-2/pangolin/Guangxi/P5L/2017__EPI_ISL_410540 spike protein (1142-1267)

SEQ ID NO: 13241 - protein, 126 aa, synthetic construct; identical to SEQ ID NO: 13177
  REGION 1..126: note = SARS-CoV-2/pangolin/Guangxi/P5E/2017__EPI_ISL_410541 spike protein (1142-1267)

SEQ ID NO: 13242 - protein, 126 aa, synthetic construct; identical to SEQ ID NO: 13177
  REGION 1..126: note = SARS-CoV-2/pangolin/Guangxi/P1E/2017__EPI_ISL_410539 spike protein (1140-1265)

SEQ ID NO: 13243 - protein, 223 aa, synthetic construct
  REGION 1..223: note = SARS-CoV-2/Wuhan/WIV05/2019__EPI_ISL_402128 spike protein (319-541)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 13244 - protein, 223 aa, synthetic construct
  REGION 1..223: note = SARS-CoV-2/bat/Yunnan/RaTG13/2013__EPI_ISL_402131 spike protein (315-537)
RVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNF

SEQ ID NO: 13245 - protein, 223 aa, synthetic construct; identical to SEQ ID NO: 13243
  REGION 1..223: note = SARS-CoV-2/Wuhan/HBCDC-HB-01/2019__EPI_ISL_402132 spike protein (319-541)

SEQ ID NO: 13246 - protein, 223 aa, synthetic construct; identical to SEQ ID NO: 13243
  REGION 1..223: note = SARS-CoV-2/Guangdong/20SF028/2020__EPI_ISL_403936 spike protein (319-541)

SEQ ID NO: 13247 - protein, 223 aa, synthetic construct; identical to SEQ ID NO: 13243
  REGION 1..223: note = SARS-CoV-2/Shenzhen/SZTH-001/2020__EPI_ISL_406592 spike protein (319-541)

SEQ ID NO: 13248 - protein, 223 aa, synthetic construct
  REGION 1..223: note = SARS-CoV-2/Shenzhen/SZTH-004/2020__EPI_ISL_406595 spike protein (319-541)
RVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 13249 - protein, 223 aa, synthetic construct
  REGION 1..223: note = SARS-CoV-2/France/IDF0372/2020__EPI_ISL_406596 spike protein (319-541)
RVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 13250 - protein, 223 aa, synthetic construct; identical to SEQ ID NO: 13243
  REGION 1..223: note = SARS-CoV-2/Australia/VIC01/2020__EPI_ISL_406844 spike protein (319-541)

SEQ ID NO: 13251 - protein, 223 aa, synthetic construct; identical to SEQ ID NO: 13243
  REGION 1..223: note = SARS-CoV-2/Germany/BavPat1/2020__EPI_ISL_406862 spike protein (319-541)

SEQ ID NO: 13252 - protein, 223 aa, synthetic construct; identical to SEQ ID NO: 13243
  REGION 1..223: note = SARS-CoV-2/Wuhan/HBCDC-HB-02/2020__EPI_ISL_412978 spike protein (319-541)

SEQ ID NO: 13253 - protein, 223 aa, synthetic construct; identical to SEQ ID NO: 13243
  REGION 1..223: note = SARS-CoV-2/Australia/QLD02/2020__EPI_ISL_407896 spike protein (319-541)

SEQ ID NO: 13254 - protein, 223 aa, synthetic construct; identical to SEQ ID NO: 13243
  REGION 1..223: note = SARS-CoV-2/India/1-31/2020__EPI_ISL_413523 spike protein (319-541)

SEQ ID NO: 13255 - protein, 223 aa, synthetic construct
  REGION 1..223: note SARS-CoV-2/Guangdong/GD2020087-P0008/2020__EPI_ISL_413863 spike protein (319-541)
RVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 13256 - protein, 223 aa, synthetic construct; identical to SEQ ID NO: 13243
  REGION 1..223: note = SARS-CoV-2/Sweden/01/2020__EPI_ISL_411951 spike protein (319-541)

SEQ ID NO: 13257 - protein, 223 aa, synthetic construct; identical to SEQ ID NO: 13243
  REGION 1..223: note = SARS-CoV-2/Tianmen/HBCDC-HB-07/2020__EPI_ISL_412983 spike protein (319-541)

SEQ ID NO: 13258 - protein, 223 aa, synthetic construct; identical to SEQ ID NO: 13243
  REGION 1..223: note = SARS-CoV-2/Hong Kong/case42_VM20002493/2020__EPI_ISL_414527 spike protein (319-541)

SEQ ID NO: 13259 - protein, 223 aa, synthetic construct; identical to SEQ ID NO: 13243
  REGION 1..223: note = SARS-CoV-2/USA/CruiseA-23/2020__EPI_ISL_414482 spike protein (319-541)

SEQ ID NO: 13260 - protein, 223 aa, synthetic construct; identical to SEQ ID NO: 13243
  REGION 1..223: note = SARS-CoV-2/Hong Kong/case85_VM20002868/2020__EPI_ISL_414519 spike protein (319-541)

SEQ ID NO: 13261 - protein, 223 aa, synthetic construct; identical to SEQ ID NO: 13243
  REGION 1..223: note = SARS-CoV-2/England/200990660/2020__EPI_ISL_414523 spike protein (319-541)

SEQ ID NO: 13262 - protein, 223 aa, synthetic construct; identical to SEQ ID NO: 13243
  REGION 1..223: note = SARS-CoV-2/Australia/NSW09/2020__EPI_ISL_413595 spike protein (319-541)

SEQ ID NO: 13263 - protein, 223 aa, synthetic construct; identical to SEQ ID NO: 13243
  REGION 1..223: note = SARS-CoV-2/Australia/NSW10/2020__EPI_ISL_413596 spike protein (319-541)

SEQ ID NO: 13264 - protein, 223 aa, synthetic construct; identical to SEQ ID NO: 13243
  REGION 1..223: note SARS-CoV-2/Switzerland/1000477797/2020__EPI_ISL_413023 spike protein (319-541)

SEQ ID NO: 13265 - protein, 223 aa, synthetic construct
  REGION 1..223: note = SARS-CoV-2/Belgium/BA-02291/2020__EPI_ISL_415159 spike protein (319-541)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNF

SEQ ID NO: 13266 - protein, 223 aa, synthetic construct; identical to SEQ ID NO: 13243
  REGION 1..223: note = SARS-CoV-2/USA/WA8-UW5/2020__EPI_ISL_413486 spike protein (319-541)

SEQ ID NO: 13267 - protein, 223 aa, synthetic construct; identical to SEQ ID NO: 13243
  REGION 1..223: note = SARS-CoV-2/England/20102000506/2020__EPI_ISL_415147 spike protein (319-541)

SEQ ID NO: 13268 - protein, 223 aa, synthetic construct; identical to SEQ ID NO: 13243
  REGION 1..223: note = SARS-CoV-2/Belgium/VAG-03013/2020__EPI_ISL_415155 spike protein (319-541)

SEQ ID NO: 13269 - protein, 223 aa, synthetic construct; identical to SEQ ID NO: 13243
  REGION 1..223: note = SARS-CoV-2/Belgium/BC-03016/2020__EPI_ISL_415157 spike protein (319-541)

SEQ ID NO: 13270 - protein, 223 aa, synthetic construct; identical to SEQ ID NO: 13243
  REGION 1..223: note = SARS-CoV-2/Germany/BavPat3/2020__EPI_ISL_414521 spike protein (319-541)

SEQ ID NO: 13271 - protein, 223 aa, synthetic construct; identical to SEQ ID NO: 13243
  REGION 1..223: note = SARS-CoV-2/France/HF1805/2020__EPI_ISL_414628 spike protein (319-541)

SEQ ID NO: 13272 - protein, 223 aa, synthetic construct; identical to SEQ ID NO: 13243
  REGION 1..223: note SARS-CoV-2/Netherlands/ZuidHolland_9/2020__EPI_ISL_414445 spike protein (319-541)

SEQ ID NO: 13273 - protein, 223 aa, synthetic construct
  REGION 1..223: note = SARS-CoV-2/Finland/FIN03032020A/2020__EPI_ISL_413602 spike protein (319-541)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 13274 - protein, 223 aa, synthetic construct; identical to SEQ ID NO: 13243
  REGION 1..223: note = SARS-CoV-2/France/GE1977/2020__EPI_ISL_414632 spike protein (319-541)

SEQ ID NO: 13275 - protein, 223 aa, synthetic construct; identical to SEQ ID NO: 13243
  REGION 1..223: note = SARS-CoV-2/Finland/FIN-313/2020__EPI_ISL_414641 spike protein (319-541)

SEQ ID NO: 13276 - protein, 223 aa, synthetic construct; identical to SEQ ID NO: 13243
  REGION 1..223: note SARS-CoV-2/Netherlands/ZuidHolland_2/2020__EPI_ISL_414556 spike protein (319-541)

SEQ ID NO: 13277 - protein, 223 aa, synthetic construct
  REGION 1..223: note = SARS-CoV-2/USA/WA-UW31/2020__EPI_ISL_414618 spike protein (319-541)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNF

SEQ ID NO: 13278 - protein, 223 aa, synthetic construct; identical to SEQ ID NO: 13243
  REGION 1..223: note = SARS-CoV-2/South Korea/SNU01/2020__EPI_ISL_411929 spike protein (319-541)

SEQ ID NO: 13279 - protein, 223 aa, synthetic construct; identical to SEQ ID NO: 13243
  REGION 1..223: note = SARS-CoV-2/China/WF0004/2020__EPI_ISL_413694 spike protein (319-541)

SEQ ID NO: 13280 - protein, 223 aa, synthetic construct; identical to SEQ ID NO: 13243
  REGION 1..223: note = SARS-CoV-2/China/WF0028/2020__EPI_ISL_413791 spike protein (319-541)

SEQ ID NO: 13281 - protein, 223 aa, synthetic construct; identical to SEQ ID NO: 13243
  REGION 1..223: note = SARS-CoV-2/2019-nCoV/USA-CruiseA-18/2020__MT159716.1 spike protein (319-541)

SEQ ID NO: 13282 - protein, 223 aa, synthetic construct; identical to SEQ ID NO: 13243
  REGION 1..223: note SARS-CoV-2/SARS-CoV-2/Yunnan-01/human/2020/CHN__MT049951.1 spike protein (319-541)

SEQ ID NO: 13283 - protein, 223 aa, synthetic construct
  REGION 1..223: note = SARS-CoV-2/USA/WA-UW292/2020__EPI_ISL_418077 spike protein (319-541)
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNF

SEQ ID NO: 13284 - protein, 223 aa, synthetic construct; identical to SEQ ID NO: 13243
  REGION 1..223: note = SARS-CoV-2/Iceland/192/2020__EPI_ISL_417819 spike protein (319-541)

SEQ ID NO: 13285 - protein, 223 aa, synthetic construct; identical to SEQ ID NO: 13243
  REGION 1..223: note = SARS-CoV-2/Belgium/ULG-6939/2020__EPI_ISL_417020 spike protein (319-541)

SEQ ID NO: 13286 - protein, 223 aa, synthetic construct; identical to SEQ ID NO: 13243
  REGION 1..223: note = SARS-CoV-2/France/HF2496/2020__EPI_ISL_418231 spike protein (319-541)

SEQ ID NO: 13287 - protein, 223 aa, synthetic construct; identical to SEQ ID NO: 13243
  REGION 1..223: note = SARS-CoV-2/USA/WA-UW291/2020__EPI_ISL_418076 spike protein (319-541)

SEQ ID NO: 13288 - protein, 223 aa, synthetic construct; identical to SEQ ID NO: 13243
  REGION 1..223: note = SARS-CoV-2/Portugal/PT0034/2020__EPI_ISL_418019 spike protein (319-541)

SEQ ID NO: 13289 - protein, 223 aa, synthetic construct; identical to SEQ ID NO: 13243
  REGION 1..223: note = SARS-CoV-2/Iceland/202/2020__EPI_ISL_417750 spike protein (319-541)

SEQ ID NO: 13290 - protein, 223 aa, synthetic construct
  REGION 1..223: note = SARS-CoV-2/USA/WA-UW261/2020__EPI_ISL_418046 spike protein (319-541)
RVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 13291 - protein, 223 aa, synthetic construct; identical to SEQ ID NO: 13243
  REGION 1..223: note = SARS-CoV-2/Portugal/PT0035/2020__EPI_ISL_418020 spike protein (319-541)

SEQ ID NO: 13292 - protein, 223 aa, synthetic construct; identical to SEQ ID NO: 13243
  REGION 1..223: note = SARS-CoV-2/USA/NY-NYUMC7/2020__EPI_ISL_418192 spike protein (319-541)

SEQ ID NO: 13293 - protein, 223 aa, synthetic construct; identical to SEQ ID NO: 13243
  REGION 1..223: note = SARS-CoV-2/Iceland/189/2020__EPI_ISL_417709 spike protein (319-541)

SEQ ID NO: 13294 - protein, 223 aa, synthetic construct; identical to SEQ ID NO: 13243
  REGION 1..223: note = SARS-CoV-2/Australia/NSW56/2020__EPI_ISL_417408 spike protein (319-541)

SEQ ID NO: 13295 - protein, 223 aa, synthetic construct; identical to SEQ ID NO: 13243
  REGION 1..223: note = SARS-CoV-2/Iceland/280/2020__EPI_ISL_417608 spike protein (319-541)

SEQ ID NO: 13296 - protein, 223 aa, synthetic construct; identical to SEQ ID NO: 13243
  REGION 1..223: note = SARS-CoV-2/Iceland/247/2020__EPI_ISL_417575 spike protein (319-541)

SEQ ID NO: 13297 - protein, 223 aa, synthetic construct; identical to SEQ ID NO: 13243
  REGION 1..223: note = SARS-CoV-2/Iceland/238/2020__EPI_ISL_417566 spike protein (319-541)

SEQ ID NO: 13298 - protein, 223 aa, synthetic construct; identical to SEQ ID NO: 13243
  REGION 1..223: note = SARS-CoV-2/Greece/16/2020__EPI_ISL_418265 spike protein (319-541)

SEQ ID NO: 13299 - protein, 223 aa, synthetic construct; identical to SEQ ID NO: 13243
  REGION 1..223: note = SARS-CoV-2/Iceland/319/2020__EPI_ISL_417648 spike protein (319-541)

SEQ ID NO: 13300 - protein, 223 aa, synthetic construct; identical to SEQ ID NO: 13243
  REGION 1..223: note = SARS-CoV-2/Congo/94/2020__EPI_ISL_417947 spike protein (319-541)

SEQ ID NO: 13301 - protein, 223 aa, synthetic construct; identical to SEQ ID NO: 13243
  REGION 1..223: note = SARS-CoV-2/Congo/158/2020__EPI_ISL_417950 spike protein (319-541)

SEQ ID NO: 13302 - protein, 223 aa, synthetic construct; identical to SEQ ID NO: 13243
  REGION 1..223: note = SARS-CoV-2/USA/UT-00034/2020__EPI_ISL_417977 spike protein (319-541)

SEQ ID NO: 13303 - protein, 223 aa, synthetic construct; identical to SEQ ID NO: 13243
  REGION 1..223: note = SARS-CoV-2/USA/UT-00033/2020__EPI_ISL_417976 spike protein (319-541)

SEQ ID NO: 13304 - protein, 223 aa, synthetic construct
  REGION 1..223: note = SARS-CoV-2/USA/WI-13/2020__EPI_ISL_417516 spike protein (319-541)
RVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 13305 - protein, 223 aa, synthetic construct
  REGION 1..223: note = SARS-CoV-2/India/1-27/2020__EPI_ISL_413522 spike protein (318-540)
RVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 13306 - protein, 223 aa, synthetic construct
  REGION 1..223: note = SARS-CoV-2/pangolin/Guangxi/P4L/2017__EPI_ISL_410538 spike protein (313-535)
RVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNF

SEQ ID NO: 13307 - protein, 223 aa, synthetic construct; identical to SEQ ID NO: 13306
  REGION 1..223: note = SARS-CoV-2/pangolin/Guangxi/P5L/2017__EPI_ISL_410540 spike protein (313-535)

SEQ ID NO: 13308 - protein, 223 aa, synthetic construct
  REGION 1..223: note = SARS-CoV-2/pangolin/Guangxi/P5E/2017__EPI_ISL_410541 spike protein (313-535)
RVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNF

SEQ ID NO: 13309 - protein, 221 aa, synthetic construct
  REGION 1..221: note = SARS-CoV-2/pangolin/Guangxi/P1E/2017__EPI_ISL_410539 spike protein (311-533)
RVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNF

SEQ ID NO: 13310 - protein, 201 aa, synthetic construct
  REGION 1..201: note = SARS-CoV-2/Wuhan/WIV05/2019__EPI_ISL_402128 spike protein (329-529)
FPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKK

SEQ ID NO: 13311 - protein, 201 aa, synthetic construct; identical to SEQ ID NO: 13310
  REGION 1..201: note = SARS-CoV-2/bat/Yunnan/RaTG13/2013__EPI_ISL_402131 spike protein (325-525)

SEQ ID NO: 13312 - protein, 201 aa, synthetic construct; identical to SEQ ID NO: 13310
  REGION 1..201: note = SARS-CoV-2/Wuhan/HBCDC-HB-01/2019__EPI_ISL_402132 spike protein (329-529)

SEQ ID NO: 13313 - protein, 201 aa, synthetic construct; identical to SEQ ID NO: 13310
  REGION 1..201: note = SARS-CoV-2/Guangdong/20SF028/2020__EPI_ISL_403936 spike protein (329-529)

SEQ ID NO: 13314 - protein, 201 aa, synthetic construct; identical to SEQ ID NO: 13310
  REGION 1..201: note = SARS-CoV-2/Shenzhen/SZTH-001/2020__EPI_ISL_406592 spike protein (329-529)

SEQ ID NO: 13315 - protein, 201 aa, synthetic construct; identical to SEQ ID NO: 13310
  REGION 1..201: note = SARS-CoV-2/Shenzhen/SZTH-004/2020__EPI_ISL_406595 spike protein (329-529)

SEQ ID NO: 13316 - protein, 201 aa, synthetic construct; identical to SEQ ID NO: 13310
  REGION 1..201: note = SARS-CoV-2/France/IDF0372/2020__EPI_ISL_406596 spike protein (329-529)

SEQ ID NO: 13317 - protein, 201 aa, synthetic construct; identical to SEQ ID NO: 13310
  REGION 1..201: note = SARS-CoV-2/Australia/VIC01/2020__EPI_ISL_406844 spike protein (329-529)

SEQ ID NO: 13318 - protein, 201 aa, synthetic construct; identical to SEQ ID NO: 13310
  REGION 1..201: note = SARS-CoV-2/Germany/BavPat1/2020__EPI_ISL_406862 spike protein (329-529)

SEQ ID NO: 13319 - protein, 201 aa, synthetic construct; identical to SEQ ID NO: 13310
  REGION 1..201: note = SARS-CoV-2/Wuhan/HBCDC-HB-02/2020__EPI_ISL_412978 spike protein (329-529)

SEQ ID NO: 13320 - protein, 201 aa, synthetic construct; identical to SEQ ID NO: 13310
  REGION 1..201: note = SARS-CoV-2/Australia/QLD02/2020__EPI_ISL_407896 spike protein (329-529)

SEQ ID NO: 13321 - protein, 201 aa, synthetic construct; identical to SEQ ID NO: 13310
  REGION 1..201: note = SARS-CoV-2/India/1-31/2020__EPI_ISL_413523 spike protein (329-529)

SEQ ID NO: 13322 - protein, 201 aa, synthetic construct; identical to SEQ ID NO: 13310
  REGION 1..201: note SARS-CoV-2/Guangdong/GD2020087-P0008/2020__EPI_ISL_413863 spike protein (329-529)

SEQ ID NO: 13323 - protein, 201 aa, synthetic construct; identical to SEQ ID NO: 13310
  REGION 1..201: note = SARS-CoV-2/Sweden/01/2020__EPI_ISL_411951 spike protein (329-529)

SEQ ID NO: 13324 - protein, 201 aa, synthetic construct; identical to SEQ ID NO: 13310
  REGION 1..201: note = SARS-CoV-2/Tianmen/HBCDC-HB-07/2020__EPI_ISL_412983 spike protein (329-529)

SEQ ID NO: 13325 - protein, 201 aa, synthetic construct; identical to SEQ ID NO: 13310
  REGION 1..201: note = SARS-CoV-2/Hong Kong/case42_VM20002493/2020__EPI_ISL_414527 spike protein (329-529)

SEQ ID NO: 13326 - protein, 201 aa, synthetic construct; identical to SEQ ID NO: 13310
  REGION 1..201: note = SARS-CoV-2/USA/CruiseA-23/2020__EPI_ISL_414482 spike protein (329-529)

SEQ ID NO: 13327 - protein, 201 aa, synthetic construct; identical to SEQ ID NO: 13310
  REGION 1..201: note = SARS-CoV-2/Hong Kong/case85_VM20002868/2020__EPI_ISL_414519 spike protein (329-529)

SEQ ID NO: 13328 - protein, 201 aa, synthetic construct; identical to SEQ ID NO: 13310
  REGION 1..201: note = SARS-CoV-2/England/200990660/2020__EPI_ISL_414523 spike protein (329-529)

SEQ ID NO: 13329 - protein, 201 aa, synthetic construct; identical to SEQ ID NO: 13310
  REGION 1..201: note = SARS-CoV-2/Australia/NSW09/2020__EPI_ISL_413595 spike protein (329-529)

SEQ ID NO: 13330 - protein, 201 aa, synthetic construct; identical to SEQ ID NO: 13310
  REGION 1..201: note = SARS-CoV-2/Australia/NSW10/2020__EPI_ISL_413596 spike protein (329-529)

SEQ ID NO: 13331 - protein, 201 aa, synthetic construct; identical to SEQ ID NO: 13310
  REGION 1..201: note SARS-CoV-2/Switzerland/1000477797/2020__EPI_ISL_413023 spike protein (329-529)

SEQ ID NO: 13332 - protein, 201 aa, synthetic construct; identical to SEQ ID NO: 13310
  REGION 1..201: note = SARS-CoV-2/Belgium/BA-02291/2020__EPI_ISL_415159 spike protein (329-529)

SEQ ID NO: 13333 - protein, 201 aa, synthetic construct; identical to SEQ ID NO: 13310
  REGION 1..201: note = SARS-CoV-2/USA/WA8-UW5/2020__EPI_ISL_413486 spike protein (329-529)

SEQ ID NO: 13334 - protein, 201 aa, synthetic construct; identical to SEQ ID NO: 13310
  REGION 1..201: note = SARS-CoV-2/England/20102000506/2020__EPI_ISL_415147 spike protein (329-529)

SEQ ID NO: 13335 - protein, 201 aa, synthetic construct; identical to SEQ ID NO: 13310
  REGION 1..201: note = SARS-CoV-2/Belgium/VAG-03013/2020__EPI_ISL_415155 spike protein (329-529)

SEQ ID NO: 13336 - protein, 201 aa, synthetic construct; identical to SEQ ID NO: 13310
  REGION 1..201: note = SARS-CoV-2/Belgium/BC-03016/2020__EPI_ISL_415157 spike protein (329-529)

SEQ ID NO: 13337 - protein, 201 aa, synthetic construct; identical to SEQ ID NO: 13310
  REGION 1..201: note = SARS-CoV-2/Germany/BavPat3/2020__EPI_ISL_414521 spike protein (329-529)

SEQ ID NO: 13338 - protein, 201 aa, synthetic construct; identical to SEQ ID NO: 13310
  REGION 1..201: note = SARS-CoV-2/France/HF1805/2020__EPI_ISL_414628 spike protein (329-529)

SEQ ID NO: 13339 - protein, 201 aa, synthetic construct; identical to SEQ ID NO: 13310
  REGION 1..201: note SARS-CoV-2/Netherlands/ZuidHolland_9/2020__EPI_ISL_414445 spike protein (329-529)

SEQ ID NO: 13340 - protein, 201 aa, synthetic construct; identical to SEQ ID NO: 13310
  REGION 1..201: note = SARS-CoV-2/Finland/FIN03032020A/2020__EPI_ISL_413602 spike protein (329-529)

SEQ ID NO: 13341 - protein, 201 aa, synthetic construct; identical to SEQ ID NO: 13310
  REGION 1..201: note = SARS-CoV-2/France/GE1977/2020__EPI_ISL_414632 spike protein (329-529)

SEQ ID NO: 13342 - protein, 201 aa, synthetic construct; identical to SEQ ID NO: 13310
  REGION 1..201: note = SARS-CoV-2/Finland/FIN-313/2020__EPI_ISL_414641 spike protein (329-529)

SEQ ID NO: 13343 - protein, 201 aa, synthetic construct; identical to SEQ ID NO: 13310
  REGION 1..201: note SARS-CoV-2/Netherlands/ZuidHolland_2/2020__EPI_ISL_414556 spike protein (329-529)

SEQ ID NO: 13344 - protein, 201 aa, synthetic construct; identical to SEQ ID NO: 13310
  REGION 1..201: note = SARS-CoV-2/USA/WA-UW31/2020__EPI_ISL_414618 spike protein (329-529)

SEQ ID NO: 13345 - protein, 201 aa, synthetic construct; identical to SEQ ID NO: 13310
  REGION 1..201: note = SARS-CoV-2/South Korea/SNU01/2020__EPI_ISL_411929 spike protein (329-529)

SEQ ID NO: 13346 - protein, 201 aa, synthetic construct; identical to SEQ ID NO: 13310
  REGION 1..201: note = SARS-CoV-2/China/WF0004/2020__EPI_ISL_413694 spike protein (329-529)

SEQ ID NO: 13347 - protein, 201 aa, synthetic construct; identical to SEQ ID NO: 13310
  REGION 1..201: note = SARS-CoV-2/China/WF0028/2020__EPI_ISL_413791 spike protein (329-529)

SEQ ID NO: 13348 - protein, 201 aa, synthetic construct; identical to SEQ ID NO: 13310
  REGION 1..201: note = SARS-CoV-2/2019-nCoV/USA-CruiseA-18/2020__MT159716.1 spike protein (329-529)

SEQ ID NO: 13349 - protein, 201 aa, synthetic construct; identical to SEQ ID NO: 13310
  REGION 1..201: note SARS-CoV-2/SARS-CoV-2/Yunnan-01/human/2020/CHN__MT049951.1 spike protein (329-529)

SEQ ID NO: 13350 - protein, 201 aa, synthetic construct; identical to SEQ ID NO: 13310
  REGION 1..201: note = SARS-CoV-2/USA/WA-UW292/2020__EPI_ISL_418077 spike protein (329-529)

SEQ ID NO: 13351 - protein, 201 aa, synthetic construct; identical to SEQ ID NO: 13310
  REGION 1..201: note = SARS-CoV-2/Iceland/192/2020__EPI_ISL_417819 spike protein (329-529)

SEQ ID NO: 13352 - protein, 201 aa, synthetic construct; identical to SEQ ID NO: 13310
  REGION 1..201: note = SARS-CoV-2/Belgium/ULG-6939/2020__EPI_ISL_417020 spike protein (329-529)

SEQ ID NO: 13353 - protein, 201 aa, synthetic construct; identical to SEQ ID NO: 13310
  REGION 1..201: note = SARS-CoV-2/France/HF2496/2020__EPI_ISL_418231 spike protein (329-529)

SEQ ID NO: 13354 - protein, 201 aa, synthetic construct; identical to SEQ ID NO: 13310
  REGION 1..201: note = SARS-CoV-2/USA/WA-UW291/2020__EPI_ISL_418076 spike protein (329-529)

SEQ ID NO: 13355 - protein, 201 aa, synthetic construct; identical to SEQ ID NO: 13310
  REGION 1..201: note = SARS-CoV-2/Portugal/PT0034/2020__EPI_ISL_418019 spike protein (329-529)

SEQ ID NO: 13356 - protein, 201 aa, synthetic construct; identical to SEQ ID NO: 13310
  REGION 1..201: note = SARS-CoV-2/Iceland/202/2020__EPI_ISL_417750 spike protein (329-529)

SEQ ID NO: 13357 - protein, 201 aa, synthetic construct; identical to SEQ ID NO: 13310
  REGION 1..201: note = SARS-CoV-2/USA/WA-UW261/2020__EPI_ISL_418046 spike protein (329-529)

SEQ ID NO: 13358 - protein, 201 aa, synthetic construct; identical to SEQ ID NO: 13310
  REGION 1..201: note = SARS-CoV-2/Portugal/PT0035/2020__EPI_ISL_418020 spike protein (329-529)

SEQ ID NO: 13359 - protein, 201 aa, synthetic construct; identical to SEQ ID NO: 13310
  REGION 1..201: note = SARS-CoV-2/USA/NY-NYUMC7/2020__EPI_ISL_418192 spike protein (329-529)

SEQ ID NO: 13360 - protein, 201 aa, synthetic construct; identical to SEQ ID NO: 13310
  REGION 1..201: note = SARS-CoV-2/Iceland/189/2020__EPI_ISL_417709 spike protein (329-529)

SEQ ID NO: 13361 - protein, 201 aa, synthetic construct; identical to SEQ ID NO: 13310
  REGION 1..201: note = SARS-CoV-2/Australia/NSW56/2020__EPI_ISL_417408 spike protein (329-529)

SEQ ID NO: 13362 - protein, 201 aa, synthetic construct; identical to SEQ ID NO: 13310
  REGION 1..201: note = SARS-CoV-2/Iceland/280/2020__EPI_ISL_417608 spike protein (329-529)

SEQ ID NO: 13363 - protein, 201 aa, synthetic construct; identical to SEQ ID NO: 13310
  REGION 1..201: note = SARS-CoV-2/Iceland/247/2020__EPI_ISL_417575 spike protein (329-529)

SEQ ID NO: 13364 - protein, 201 aa, synthetic construct; identical to SEQ ID NO: 13310
  REGION 1..201: note = SARS-CoV-2/Iceland/238/2020__EPI_ISL_417566 spike protein (329-529)

SEQ ID NO: 13365 - protein, 201 aa, synthetic construct; identical to SEQ ID NO: 13310
  REGION 1..201: note = SARS-CoV-2/Greece/16/2020__EPI_ISL_418265 spike protein (329-529)

SEQ ID NO: 13366 - protein, 201 aa, synthetic construct; identical to SEQ ID NO: 13310
  REGION 1..201: note = SARS-CoV-2/Iceland/319/2020__EPI_ISL_417648 spike protein (329-529)

SEQ ID NO: 13367 - protein, 201 aa, synthetic construct; identical to SEQ ID NO: 13310
  REGION 1..201: note = SARS-CoV-2/Congo/94/2020__EPI_ISL_417947 spike protein (329-529)

SEQ ID NO: 13368 - protein, 201 aa, synthetic construct; identical to SEQ ID NO: 13310
  REGION 1..201: note = SARS-CoV-2/Congo/158/2020__EPI_ISL_417950 spike protein (329-529)

SEQ ID NO: 13369 - protein, 201 aa, synthetic construct; identical to SEQ ID NO: 13310
  REGION 1..201: note = SARS-CoV-2/USA/UT-00034/2020__EPI_ISL_417977 spike protein (329-529)

SEQ ID NO: 13370 - protein, 201 aa, synthetic construct; identical to SEQ ID NO: 13310
  REGION 1..201: note = SARS-CoV-2/USA/UT-00033/2020__EPI_ISL_417976 spike protein (329-529)

SEQ ID NO: 13371 - protein, 201 aa, synthetic construct; identical to SEQ ID NO: 13310
  REGION 1..201: note = SARS-CoV-2/USA/WI-13/2020__EPI_ISL_417516 spike protein (329-529)

SEQ ID NO: 13372 - protein, 201 aa, synthetic construct
  REGION 1..201: note = SARS-CoV-2/India/1-27/2020__EPI_ISL_413522 spike protein (328-528)
FPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKK

SEQ ID NO: 13373 - protein, 201 aa, synthetic construct
  REGION 1..201: note = SARS-CoV-2/pangolin/Guangxi/P4L/2017__EPI_ISL_410538 spike protein (323-523)
FPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKL

SEQ ID NO: 13374 - protein, 201 aa, synthetic construct; identical to SEQ ID NO: 13373
  REGION 1..201: note = SARS-CoV-2/pangolin/Guangxi/P5L/2017__EPI_ISL_410540 spike protein (323-523)

SEQ ID NO: 13375 - protein, 201 aa, synthetic construct
  REGION 1..201: note = SARS-CoV-2/pangolin/Guangxi/P5E/2017__EPI_ISL_410541 spike protein (323-523)
FPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKL

SEQ ID NO: 13376 - protein, 199 aa, synthetic construct
  REGION 1..199: note = SARS-CoV-2/pangolin/Guangxi/P1E/2017__EPI_ISL_410539 spike protein (321-521)
FPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKL

SEQ ID NO: 13377 - protein, 1211 aa, synthetic construct
  REGION 1..1211: note = SARS-CoV-2/Wuhan/WIV05/2019__EPI_ISL_402128 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13378 - protein, 1207 aa, synthetic construct
  REGION 1..1207: note = SARS-CoV-2/bat/Yunnan/RaTG13/2013__EPI_ISL_402131 spike protein (1-1207)(N910C_S1119C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13379 - protein, 1211 aa, synthetic construct
  REGION 1..1211: note = SARS-CoV-2/Wuhan/HBCDC-HB-01/2019__EPI_ISL_402132 spike protein (1-1211)(N914C_S1123C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13380 - protein, 1211 aa, synthetic construct
  REGION 1..1211: note = SARS-CoV-2/Guangdong/20SF028/2020__EPI_ISL_403936 spike protein (1-1211)(N914C_S1123C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13381 - protein, 1211 aa, synthetic construct
  REGION 1..1211: note = SARS-CoV-2/Shenzhen/SZTH-001/2020__EPI_ISL_406592 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDSFKEELDKYFKNHTSPDVDLGDISGINASVVNIQKEIDRLNEVAKNLNESLIDLQELGKYEQYIK

SEQ ID NO: 13382 - protein, 1211 aa, synthetic construct
  REGION 1..1211: note = SARS-CoV-2/Shenzhen/SZTH-004/2020__EPI_ISL_406595 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13383 - protein, 1211 aa, synthetic construct
  REGION 1..1211: note = SARS-CoV-2/France/IDF0372/2020__EPI_ISL_406596 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13384 - protein, 1211 aa, synthetic construct
  REGION 1..1211: note = SARS-CoV-2/Australia/VIC01/2020__EPI_ISL_406844 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13385 - protein, 1211 aa, synthetic construct
  REGION 1..1211: note = SARS-CoV-2/Germany/BavPat1/2020__EPI_ISL_406862 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13386 - protein, 1211 aa, synthetic construct
  REGION 1..1211: note = SARS-CoV-2/Wuhan/HBCDC-HB-02/2020__EPI_ISL_412978 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13387 - protein, 1211 aa, synthetic construct
  REGION 1..1211: note = SARS-CoV-2/Australia/QLD02/2020__EPI_ISL_407896 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDSFKEELDKYFKNHTSPDVDLGDISGINASVVNIQKEIDRLNEVAKNLNESLIDLQELGKYEQYIK

SEQ ID NO: 13388 - protein, 1211 aa, synthetic construct
  REGION 1..1211: note = SARS-CoV-2/India/1-31/2020__EPI_ISL_413523 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13389 - protein, 1211 aa, synthetic construct
  REGION 1..1211: note SARS-CoV-2/Guangdong/GD2020087-P0008/2020__EPI_ISL_413863 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13390 - protein, 1211 aa, synthetic construct
  REGION 1..1211: note = SARS-CoV-2/Sweden/01/2020__EPI_ISL_411951 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13391 - protein, 1211 aa, synthetic construct
  REGION 1..1211: note = SARS-CoV-2/Tianmen/HBCDC-HB-07/2020__EPI_ISL_412983 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13392 - protein, 1211 aa, synthetic construct
  REGION 1..1211: note = SARS-CoV-2/Hong Kong/case42_VM20002493/2020__EPI_ISL_414527 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13393 - protein, 1211 aa, synthetic construct
  REGION 1..1211: note = SARS-CoV-2/USA/CruiseA-23/2020__EPI_ISL_414482 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13394 - protein, 1211 aa, synthetic construct
  REGION 1..1211: note = SARS-CoV-2/Hong Kong/case85_VM20002868/2020__EPI_ISL_414519 spike protein (1-1211)(N914C_S1123C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13395 - protein, 1211 aa, synthetic construct; identical to SEQ ID NO: 13385
  REGION 1..1211: note = SARS-CoV-2/England/200990660/2020__EPI_ISL_414523 spike protein (1-1211)(N914C_S1123C)

SEQ ID NO: 13396 - protein, 1211 aa, synthetic construct
  REGION 1..1211: note = SARS-CoV-2/Australia/NSW09/2020__EPI_ISL_413595 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13397 - protein, 1211 aa, synthetic construct; identical to SEQ ID NO: 13377
  REGION 1..1211: note = SARS-CoV-2/Australia/NSW10/2020__EPI_ISL_413596 spike protein (1-1211)(N914C_S1123C)

SEQ ID NO: 13398 - protein, 1211 aa, synthetic construct
  REGION 1..1211: note SARS-CoV-2/Switzerland/1000477797/2020__EPI_ISL_413023 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13399 - protein, 1211 aa, synthetic construct
  REGION 1..1211: note = SARS-CoV-2/Belgium/BA-02291/2020__EPI_ISL_415159 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13400 - protein, 1211 aa, synthetic construct
  REGION 1..1211: note = SARS-CoV-2/USA/WA8-UW5/2020__EPI_ISL_413486 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13401 - protein, 1211 aa, synthetic construct
  REGION 1..1211: note = SARS-CoV-2/England/20102000506/2020__EPI_ISL_415147 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13402 - protein, 1211 aa, synthetic construct
  REGION 1..1211: note = SARS-CoV-2/Belgium/VAG-03013/2020__EPI_ISL_415155 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13403 - protein, 1211 aa, synthetic construct
  REGION 1..1211: note = SARS-CoV-2/Belgium/BC-03016/2020__EPI_ISL_415157 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13404 - protein, 1211 aa, synthetic construct
  REGION 1..1211: note = SARS-CoV-2/Germany/BavPat3/2020__EPI_ISL_414521 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13405 - protein, 1211 aa, synthetic construct
  REGION 1..1211: note = SARS-CoV-2/France/HF1805/2020__EPI_ISL_414628 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDSFKEELDKYFKNHTSPDVDLGDISGINASVVNIQKEIDRLNEVAKNLNESLIDLQELGKYEQYIK

SEQ ID NO: 13406 - protein, 1211 aa, synthetic construct
  REGION 1..1211: note SARS-CoV-2/Netherlands/ZuidHolland_9/2020__EPI_ISL_414445 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13407 - protein, 1211 aa, synthetic construct
  REGION 1..1211: note = SARS-CoV-2/Finland/FIN03032020A/2020__EPI_ISL_413602 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13408 - protein, 1211 aa, synthetic construct
  REGION 1..1211: note = SARS-CoV-2/France/GE1977/2020__EPI_ISL_414632 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13409 - protein, 1211 aa, synthetic construct
  REGION 1..1211: note = SARS-CoV-2/Finland/FIN-313/2020__EPI_ISL_414641 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13410 - protein, 1211 aa, synthetic construct
  REGION 1..1211: note SARS-CoV-2/Netherlands/ZuidHolland_2/2020__EPI_ISL_414556 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13411 - protein, 1211 aa, synthetic construct
  REGION 1..1211: note = SARS-CoV-2/USA/WA-UW31/2020__EPI_ISL_414618 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13412 - protein, 1211 aa, synthetic construct
  REGION 1..1211: note = SARS-CoV-2/South Korea/SNU01/2020__EPI_ISL_411929 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13413 - protein, 1211 aa, synthetic construct
  REGION 1..1211: note = SARS-CoV-2/China/WF0004/2020__EPI_ISL_413694 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13414 - protein, 1211 aa, synthetic construct
  REGION 1..1211: note = SARS-CoV-2/China/WF0028/2020__EPI_ISL_413791 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELESFKEELDKYFKNHTSPDVDLGDISGINASVVNIQKEIDRLNEVAKNLNESLIDLQELGKYEQYIK

SEQ ID NO: 13415 - protein, 1211 aa, synthetic construct
  REGION 1..1211: note = SARS-CoV-2/2019-nCoV/USA-CruiseA-18/2020__MT159716.1 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13416 - protein, 1211 aa, synthetic construct
  REGION 1..1211: note SARS-CoV-2/SARS-CoV-2/Yunnan-01/human/2020/CHN__MT049951.1 spike protein (1-1211)(N914C_S1123C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13417 - protein, 1211 aa, synthetic construct
  REGION 1..1211: note = SARS-CoV-2/USA/WA-UW292/2020__EPI_ISL_418077 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13418 - protein, 1211 aa, synthetic construct
  REGION 1..1211: note = SARS-CoV-2/Iceland/192/2020__EPI_ISL_417819 spike protein (1-1211)(N914C_S1123C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13419 - protein, 1211 aa, synthetic construct
  REGION 1..1211: note = SARS-CoV-2/Belgium/ULG-6939/2020__EPI_ISL_417020 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13420 - protein, 1211 aa, synthetic construct
  REGION 1..1211: note = SARS-CoV-2/France/HF2496/2020__EPI_ISL_418231 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13421 - protein, 1211 aa, synthetic construct
  REGION 1..1211: note = SARS-CoV-2/USA/WA-UW291/2020__EPI_ISL_418076 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13422 - protein, 1211 aa, synthetic construct; identical to SEQ ID NO: 13385
  REGION 1..1211: note = SARS-CoV-2/Portugal/PT0034/2020__EPI_ISL_418019 spike protein (1-1211)(N914C_S1123C)

SEQ ID NO: 13423 - protein, 1211 aa, synthetic construct
  REGION 1..1211: note = SARS-CoV-2/Iceland/202/2020__EPI_ISL_417750 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDIPGINASVVNIQKEIDRLNEVAKNLNESLIDLQELGKYEQYIK

SEQ ID NO: 13424 - protein, 1211 aa, synthetic construct
  REGION 1..1211: note = SARS-CoV-2/USA/WA-UW261/2020__EPI_ISL_418046 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13425 - protein, 1211 aa, synthetic construct
  REGION 1..1211: note = SARS-CoV-2/Portugal/PT0035/2020__EPI_ISL_418020 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13426 - protein, 1211 aa, synthetic construct
  REGION 1..1211: note = SARS-CoV-2/USA/NY-NYUMC7/2020__EPI_ISL_418192 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13427 - protein, 1211 aa, synthetic construct
  REGION 1..1211: note = SARS-CoV-2/Iceland/189/2020__EPI_ISL_417709 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13428 - protein, 1211 aa, synthetic construct
  REGION 1..1211: note = SARS-CoV-2/Australia/NSW56/2020__EPI_ISL_417408 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13429 - protein, 1211 aa, synthetic construct
  REGION 1..1211: note = SARS-CoV-2/Iceland/280/2020__EPI_ISL_417608 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13430 - protein, 1211 aa, synthetic construct; identical to SEQ ID NO: 13385
  REGION 1..1211: note = SARS-CoV-2/Iceland/247/2020__EPI_ISL_417575 spike protein (1-1211)(N914C_S1123C)

SEQ ID NO: 13431 - protein, 1211 aa, synthetic construct
  REGION 1..1211: note = SARS-CoV-2/Iceland/238/2020__EPI_ISL_417566 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13432 - protein, 1211 aa, synthetic construct
  REGION 1..1211: note = SARS-CoV-2/Greece/16/2020__EPI_ISL_418265 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13433 - protein, 1211 aa, synthetic construct
  REGION 1..1211: note = SARS-CoV-2/Iceland/319/2020__EPI_ISL_417648 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13434 - protein, 1211 aa, synthetic construct
  REGION 1..1211: note = SARS-CoV-2/Congo/94/2020__EPI_ISL_417947 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13435 - protein, 1211 aa, synthetic construct
  REGION 1..1211: note = SARS-CoV-2/Congo/158/2020__EPI_ISL_417950 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13436 - protein, 1211 aa, synthetic construct
  REGION 1..1211: note = SARS-CoV-2/USA/UT-00034/2020__EPI_ISL_417977 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13437 - protein, 1211 aa, synthetic construct
  REGION 1..1211: note = SARS-CoV-2/USA/UT-00033/2020__EPI_ISL_417976 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13438 - protein, 1211 aa, synthetic construct
  REGION 1..1211: note = SARS-CoV-2/USA/WI-13/2020__EPI_ISL_417516 spike protein (1-1211)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13439 - protein, 1210 aa, synthetic construct
  REGION 1..1210: note = SARS-CoV-2/India/1-27/2020__EPI_ISL_413522 spike protein (1-1210)(N913C_S1122C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13440 - protein, 1205 aa, synthetic construct
  REGION 1..1205: note = SARS-CoV-2/pangolin/Guangxi/P4L/2017__EPI_ISL_410538 spike protein (1-1205)(N908C_S1117C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESPIDLQELGKYEQYIK

SEQ ID NO: 13441 - protein, 1205 aa, synthetic construct
  REGION 1..1205: note = SARS-CoV-2/pangolin/Guangxi/P5L/2017__EPI_ISL_410540 spike protein (1-1205)(N908C_S1117C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13442 - protein, 1205 aa, synthetic construct
  REGION 1..1205: note = SARS-CoV-2/pangolin/Guangxi/P5E/2017__EPI_ISL_410541 spike protein (1-1205)(N908C_S1117C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13443 - protein, 1203 aa, synthetic construct
  REGION 1..1203: note = SARS-CoV-2/pangolin/Guangxi/P1E/2017__EPI_ISL_410539 spike protein (1-1203)(N906C_S1115C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 13444 - protein, 1147 aa, synthetic construct
  REGION 1..1147: note = SARS-CoV-2/Wuhan/WIV05/2019__EPI_ISL_402128 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13445 - protein, 1143 aa, synthetic construct
  REGION 1..1143: note = SARS-CoV-2/bat/Yunnan/RaTG13/2013__EPI_ISL_402131 spike protein (1-1143)(N910C_S1119C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDS

SEQ ID NO: 13446 - protein, 1147 aa, synthetic construct
  REGION 1..1147: note = SARS-CoV-2/Wuhan/HBCDC-HB-01/2019__EPI_ISL_402132 spike protein (1-1147)(N914C_S1123C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13447 - protein, 1147 aa, synthetic construct
  REGION 1..1147: note = SARS-CoV-2/Guangdong/20SF028/2020__EPI_ISL_403936 spike protein (1-1147)(N914C_S1123C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13448 - protein, 1147 aa, synthetic construct
  REGION 1..1147: note = SARS-CoV-2/Shenzhen/SZTH-001/2020__EPI_ISL_406592 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDS

SEQ ID NO: 13449 - protein, 1147 aa, synthetic construct
  REGION 1..1147: note = SARS-CoV-2/Shenzhen/SZTH-004/2020__EPI_ISL_406595 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13450 - protein, 1147 aa, synthetic construct
  REGION 1..1147: note = SARS-CoV-2/France/IDF0372/2020__EPI_ISL_406596 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13451 - protein, 1147 aa, synthetic construct
  REGION 1..1147: note = SARS-CoV-2/Australia/VIC01/2020__EPI_ISL_406844 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13452 - protein, 1147 aa, synthetic construct
  REGION 1..1147: note = SARS-CoV-2/Germany/BavPat1/2020__EPI_ISL_406862 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13453 - protein, 1147 aa, synthetic construct
  REGION 1..1147: note = SARS-CoV-2/Wuhan/HBCDC-HB-02/2020__EPI_ISL_412978 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13454 - protein, 1147 aa, synthetic construct
  REGION 1..1147: note = SARS-CoV-2/Australia/QLD02/2020__EPI_ISL_407896 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDS

SEQ ID NO: 13455 - protein, 1147 aa, synthetic construct
  REGION 1..1147: note = SARS-CoV-2/India/1-31/2020__EPI_ISL_413523 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13456 - protein, 1147 aa, synthetic construct
  REGION 1..1147: note SARS-CoV-2/Guangdong/GD2020087-P0008/2020__EPI_ISL_413863 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13457 - protein, 1147 aa, synthetic construct
  REGION 1..1147: note = SARS-CoV-2/Sweden/01/2020__EPI_ISL_411951 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13458 - protein, 1147 aa, synthetic construct
  REGION 1..1147: note = SARS-CoV-2/Tianmen/HBCDC-HB-07/2020__EPI_ISL_412983 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13459 - protein, 1147 aa, synthetic construct
  REGION 1..1147: note = SARS-CoV-2/Hong Kong/case42_VM20002493/2020__EPI_ISL_414527 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13460 - protein, 1147 aa, synthetic construct
  REGION 1..1147: note = SARS-CoV-2/USA/CruiseA-23/2020__EPI_ISL_414482 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13461 - protein, 1147 aa, synthetic construct
  REGION 1..1147: note = SARS-CoV-2/Hong Kong/case85_VM20002868/2020__EPI_ISL_414519 spike protein (1-1147)(N914C_S1123C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13462 - protein, 1147 aa, synthetic construct; identical to SEQ ID NO: 13452
  REGION 1..1147: note = SARS-CoV-2/England/200990660/2020__EPI_ISL_414523 spike protein (1-1147)(N914C_S1123C)

SEQ ID NO: 13463 - protein, 1147 aa, synthetic construct
  REGION 1..1147: note = SARS-CoV-2/Australia/NSW09/2020__EPI_ISL_413595 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13464 - protein, 1147 aa, synthetic construct; identical to SEQ ID NO: 13444
  REGION 1..1147: note = SARS-CoV-2/Australia/NSW10/2020__EPI_ISL_413596 spike protein (1-1147)(N914C_S1123C)

SEQ ID NO: 13465 - protein, 1147 aa, synthetic construct
  REGION 1..1147: note SARS-CoV-2/Switzerland/1000477797/2020__EPI_ISL_413023 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13466 - protein, 1147 aa, synthetic construct
  REGION 1..1147: note = SARS-CoV-2/Belgium/BA-02291/2020__EPI_ISL_415159 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13467 - protein, 1147 aa, synthetic construct
  REGION 1..1147: note = SARS-CoV-2/USA/WA8-UW5/2020__EPI_ISL_413486 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13468 - protein, 1147 aa, synthetic construct
  REGION 1..1147: note = SARS-CoV-2/England/20102000506/2020__EPI_ISL_415147 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13469 - protein, 1147 aa, synthetic construct
  REGION 1..1147: note = SARS-CoV-2/Belgium/VAG-03013/2020__EPI_ISL_415155 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13470 - protein, 1147 aa, synthetic construct
  REGION 1..1147: note = SARS-CoV-2/Belgium/BC-03016/2020__EPI_ISL_415157 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13471 - protein, 1147 aa, synthetic construct
  REGION 1..1147: note = SARS-CoV-2/Germany/BavPat3/2020__EPI_ISL_414521 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13472 - protein, 1147 aa, synthetic construct
  REGION 1..1147: note = SARS-CoV-2/France/HF1805/2020__EPI_ISL_414628 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDS

SEQ ID NO: 13473 - protein, 1147 aa, synthetic construct
  REGION 1..1147: note SARS-CoV-2/Netherlands/ZuidHolland_9/2020__EPI_ISL_414445 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13474 - protein, 1147 aa, synthetic construct
  REGION 1..1147: note = SARS-CoV-2/Finland/FIN03032020A/2020__EPI_ISL_413602 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13475 - protein, 1147 aa, synthetic construct
  REGION 1..1147: note = SARS-CoV-2/France/GE1977/2020__EPI_ISL_414632 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13476 - protein, 1147 aa, synthetic construct
  REGION 1..1147: note = SARS-CoV-2/Finland/FIN-313/2020__EPI_ISL_414641 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13477 - protein, 1147 aa, synthetic construct
  REGION 1..1147: note SARS-CoV-2/Netherlands/ZuidHolland_2/2020__EPI_ISL_414556 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13478 - protein, 1147 aa, synthetic construct
  REGION 1..1147: note = SARS-CoV-2/USA/WA-UW31/2020__EPI_ISL_414618 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13479 - protein, 1147 aa, synthetic construct
  REGION 1..1147: note = SARS-CoV-2/South Korea/SNU01/2020__EPI_ISL_411929 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13480 - protein, 1147 aa, synthetic construct
  REGION 1..1147: note = SARS-CoV-2/China/WF0004/2020__EPI_ISL_413694 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13481 - protein, 1147 aa, synthetic construct
  REGION 1..1147: note = SARS-CoV-2/China/WF0028/2020__EPI_ISL_413791 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELES

SEQ ID NO: 13482 - protein, 1147 aa, synthetic construct
  REGION 1..1147: note = SARS-CoV-2/2019-nCoV/USA-CruiseA-18/2020__MT159716.1 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13483 - protein, 1147 aa, synthetic construct
  REGION 1..1147: note SARS-CoV-2/SARS-CoV-2/Yunnan-01/human/2020/CHN__MT049951.1 spike protein (1-1147)(N914C_S1123C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13484 - protein, 1147 aa, synthetic construct
  REGION 1..1147: note = SARS-CoV-2/USA/WA-UW292/2020__EPI_ISL_418077 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13485 - protein, 1147 aa, synthetic construct
  REGION 1..1147: note = SARS-CoV-2/Iceland/192/2020__EPI_ISL_417819 spike protein (1-1147)(N914C_S1123C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13486 - protein, 1147 aa, synthetic construct
  REGION 1..1147: note = SARS-CoV-2/Belgium/ULG-6939/2020__EPI_ISL_417020 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13487 - protein, 1147 aa, synthetic construct
  REGION 1..1147: note = SARS-CoV-2/France/HF2496/2020__EPI_ISL_418231 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13488 - protein, 1147 aa, synthetic construct
  REGION 1..1147: note = SARS-CoV-2/USA/WA-UW291/2020__EPI_ISL_418076 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13489 - protein, 1147 aa, synthetic construct; identical to SEQ ID NO: 13452
  REGION 1..1147: note = SARS-CoV-2/Portugal/PT0034/2020__EPI_ISL_418019 spike protein (1-1147)(N914C_S1123C)

SEQ ID NO: 13490 - protein, 1147 aa, synthetic construct; identical to SEQ ID NO: 13444
  REGION 1..1147: note = SARS-CoV-2/Iceland/202/2020__EPI_ISL_417750 spike protein (1-1147)(N914C_S1123C)

SEQ ID NO: 13491 - protein, 1147 aa, synthetic construct
  REGION 1..1147: note = SARS-CoV-2/USA/WA-UW261/2020__EPI_ISL_418046 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13492 - protein, 1147 aa, synthetic construct
  REGION 1..1147: note = SARS-CoV-2/Portugal/PT0035/2020__EPI_ISL_418020 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13493 - protein, 1147 aa, synthetic construct
  REGION 1..1147: note = SARS-CoV-2/USA/NY-NYUMC7/2020__EPI_ISL_418192 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13494 - protein, 1147 aa, synthetic construct
  REGION 1..1147: note = SARS-CoV-2/Iceland/189/2020__EPI_ISL_417709 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13495 - protein, 1147 aa, synthetic construct
  REGION 1..1147: note = SARS-CoV-2/Australia/NSW56/2020__EPI_ISL_417408 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13496 - protein, 1147 aa, synthetic construct
  REGION 1..1147: note = SARS-CoV-2/Iceland/280/2020__EPI_ISL_417608 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13497 - protein, 1147 aa, synthetic construct; identical to SEQ ID NO: 13452
  REGION 1..1147: note = SARS-CoV-2/Iceland/247/2020__EPI_ISL_417575 spike protein (1-1147)(N914C_S1123C)

SEQ ID NO: 13498 - protein, 1147 aa, synthetic construct
  REGION 1..1147: note = SARS-CoV-2/Iceland/238/2020__EPI_ISL_417566 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13499 - protein, 1147 aa, synthetic construct
  REGION 1..1147: note = SARS-CoV-2/Greece/16/2020__EPI_ISL_418265 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13500 - protein, 1147 aa, synthetic construct
  REGION 1..1147: note = SARS-CoV-2/Iceland/319/2020__EPI_ISL_417648 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13501 - protein, 1147 aa, synthetic construct
  REGION 1..1147: note = SARS-CoV-2/Congo/94/2020__EPI_ISL_417947 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13502 - protein, 1147 aa, synthetic construct
  REGION 1..1147: note = SARS-CoV-2/Congo/158/2020__EPI_ISL_417950 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDS

SEQ ID NO: 13503 - protein, 1147 aa, synthetic construct
  REGION 1..1147: note = SARS-CoV-2/USA/UT-00034/2020__EPI_ISL_417977 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13504 - protein, 1147 aa, synthetic construct
  REGION 1..1147: note = SARS-CoV-2/USA/UT-00033/2020__EPI_ISL_417976 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13505 - protein, 1147 aa, synthetic construct
  REGION 1..1147: note = SARS-CoV-2/USA/WI-13/2020__EPI_ISL_417516 spike protein (1-1147)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13506 - protein, 1146 aa, synthetic construct
  REGION 1..1146: note = SARS-CoV-2/India/1-27/2020__EPI_ISL_413522 spike protein (1-1146)(N913C_S1122C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDS

SEQ ID NO: 13507 - protein, 1141 aa, synthetic construct
  REGION 1..1141: note = SARS-CoV-2/pangolin/Guangxi/P4L/2017__EPI_ISL_410538 spike protein (1-1141)(N908C_S1117C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDS

SEQ ID NO: 13508 - protein, 1141 aa, synthetic construct
  REGION 1..1141: note = SARS-CoV-2/pangolin/Guangxi/P5L/2017__EPI_ISL_410540 spike protein (1-1141)(N908C_S1117C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDS

SEQ ID NO: 13509 - protein, 1141 aa, synthetic construct
  REGION 1..1141: note = SARS-CoV-2/pangolin/Guangxi/P5E/2017__EPI_ISL_410541 spike protein (1-1141)(N908C_S1117C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDS

SEQ ID NO: 13510 - protein, 1139 aa, synthetic construct
  REGION 1..1139: note = SARS-CoV-2/pangolin/Guangxi/P1E/2017__EPI_ISL_410539 spike protein (1-1139)(N906C_S1115C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDS

SEQ ID NO: 13511 - RNA, 381 nt, synthetic construct
  misc_feature 1..381: note = SARS-CoV-2/Wuhan/WIV05/2019__EPI_ISL_402128 spike protein CDS gc (1148-1273)
  source 1..381: mol_type = other RNA
ttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 13512 - RNA, 669 nt, synthetic construct
  misc_feature 1..669: note = SARS-CoV-2/Wuhan/WIV05/2019__EPI_ISL_402128 spike protein CDS gc (319-541)
  source 1..669: mol_type = other RNA
cgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttc

SEQ ID NO: 13513 - RNA, 603 nt, synthetic construct
  misc_feature 1..603: note = SARS-CoV-2/Wuhan/WIV05/2019__EPI_ISL_402128 spike protein CDS gc (329-529)
  source 1..603: mol_type = other RNA
ttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaag

SEQ ID NO: 13514 - RNA, 3633 nt, synthetic construct
  misc_feature 1..3633: note = SARS-CoV-2/Wuhan/WIV05/2019__EPI_ISL_402128 spike protein CDS gc (1-1211)(N914C_S1123C)
  source 1..3633: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaag

SEQ ID NO: 13515 - RNA, 3441 nt, synthetic construct
  misc_feature 1..3441: note = SARS-CoV-2/Wuhan/WIV05/2019__EPI_ISL_402128 spike protein CDS gc (1-1147)(N914C_S1123C)
  source 1..3441: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactcc

SEQ ID NO: 13516 - RNA, 381 nt, synthetic construct
  misc_feature 1..381: note = SARS-CoV-2/Wuhan/WIV05/2019__EPI_ISL_402128 spike protein CDS gc mod (1148-1273)
  source 1..381: mol_type = other RNA
ttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 13517 - RNA, 669 nt, synthetic construct
  misc_feature 1..669: note = SARS-CoV-2/Wuhan/WIV05/2019__EPI_ISL_402128 spike protein CDS gc mod (319-541)
  source 1..669: mol_type = other RNA
cgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttc

SEQ ID NO: 13518 - RNA, 603 nt, synthetic construct
  misc_feature 1..603: note = SARS-CoV-2/Wuhan/WIV05/2019__EPI_ISL_402128 spike protein CDS gc mod (329-529)
  source 1..603: mol_type = other RNA
ttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaa

SEQ ID NO: 13519 - RNA, 3633 nt, synthetic construct
  misc_feature 1..3633: note = SARS-CoV-2/Wuhan/WIV05/2019__EPI_ISL_402128 spike protein CDS gc mod (1-1211)(N914C_S1123C)
  source 1..3633: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaag

SEQ ID NO: 13520 - RNA, 3441 nt, synthetic construct
  misc_feature 1..3441: note = SARS-CoV-2/Wuhan/WIV05/2019__EPI_ISL_402128 spike protein CDS gc mod (1-1147)(N914C_S1123C)
  source 1..3441: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagc

SEQ ID NO: 13521 - protein, 1273 aa, synthetic construct
  REGION 1..1273: note = SARS-CoV-2/Wuhan/WIV05/2019__EPI_ISL_402128 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13522 - protein, 1269 aa, synthetic construct
  REGION 1..1269: note = SARS-CoV-2/bat/Yunnan/RaTG13/2013__EPI_ISL_402131 spike protein (1-1273)(N910C_S1119C)
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 13523 - protein, 1273 aa, synthetic construct
  REGION 1..1273: note = SARS-CoV-2/Wuhan/HBCDC-HB-01/2019__EPI_ISL_402132 spike protein (1-1273)(N914C_S1123C)
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13524 - protein, 1273 aa, synthetic construct
  REGION 1..1273: note = SARS-CoV-2/Guangdong/20SF028/2020__EPI_ISL_403936 spike protein (1-1273)(N914C_S1123C)
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13525 - protein, 1273 aa, synthetic construct
  REGION 1..1273: note = SARS-CoV-2/Shenzhen/SZTH-001/2020__EPI_ISL_406592 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSGPVLKGVKLHYT

SEQ ID NO: 13526 - protein, 1273 aa, synthetic construct
  REGION 1..1273: note = SARS-CoV-2/Shenzhen/SZTH-004/2020__EPI_ISL_406595 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13527 - protein, 1273 aa, synthetic construct
  REGION 1..1273: note = SARS-CoV-2/France/IDF0372/2020__EPI_ISL_406596 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13528 - protein, 1273 aa, synthetic construct
  REGION 1..1273: note = SARS-CoV-2/Australia/VIC01/2020__EPI_ISL_406844 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13529 - protein, 1273 aa, synthetic construct
  REGION 1..1273: note = SARS-CoV-2/Germany/BavPat1/2020__EPI_ISL_406862 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13530 - protein, 1273 aa, synthetic construct
  REGION 1..1273: note = SARS-CoV-2/Wuhan/HBCDC-HB-02/2020__EPI_ISL_412978 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13531 - protein, 1273 aa, synthetic construct
  REGION 1..1273: note = SARS-CoV-2/Australia/QLD02/2020__EPI_ISL_407896 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13532 - protein, 1273 aa, synthetic construct
  REGION 1..1273: note = SARS-CoV-2/India/1-31/2020__EPI_ISL_413523 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13533 - protein, 1273 aa, synthetic construct
  REGION 1..1273: note SARS-CoV-2/Guangdong/GD2020087-P0008/2020__EPI_ISL_413863 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13534 - protein, 1273 aa, synthetic construct
  REGION 1..1273: note = SARS-CoV-2/Sweden/01/2020__EPI_ISL_411951 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13535 - protein, 1273 aa, synthetic construct
  REGION 1..1273: note = SARS-CoV-2/Tianmen/HBCDC-HB-07/2020__EPI_ISL_412983 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13536 - protein, 1273 aa, synthetic construct
  REGION 1..1273: note = SARS-CoV-2/Hong Kong/case42_VM20002493/2020__EPI_ISL_414527 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13537 - protein, 1273 aa, synthetic construct
  REGION 1..1273: note = SARS-CoV-2/USA/CruiseA-23/2020__EPI_ISL_414482 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13538 - protein, 1273 aa, synthetic construct
  REGION 1..1273: note = SARS-CoV-2/Hong Kong/case85_VM20002868/2020__EPI_ISL_414519 spike protein (1-1273)(N914C_S1123C)
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13539 - protein, 1273 aa, synthetic construct
  REGION 1..1273: note = SARS-CoV-2/England/200990660/2020__EPI_ISL_414523 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSELVLKGVKLHYT

SEQ ID NO: 13540 - protein, 1273 aa, synthetic construct
  REGION 1..1273: note = SARS-CoV-2/Australia/NSW09/2020__EPI_ISL_413595 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13541 - protein, 1273 aa, synthetic construct
  REGION 1..1273: note = SARS-CoV-2/Australia/NSW10/2020__EPI_ISL_413596 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCFKFDEDDSEPVLKGVKLHYT

SEQ ID NO: 13542 - protein, 1273 aa, synthetic construct
  REGION 1..1273: note SARS-CoV-2/Switzerland/1000477797/2020__EPI_ISL_413023 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13543 - protein, 1273 aa, synthetic construct
  REGION 1..1273: note = SARS-CoV-2/Belgium/BA-02291/2020__EPI_ISL_415159 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13544 - protein, 1273 aa, synthetic construct
  REGION 1..1273: note = SARS-CoV-2/USA/WA8-UW5/2020__EPI_ISL_413486 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13545 - protein, 1273 aa, synthetic construct
  REGION 1..1273: note = SARS-CoV-2/England/20102000506/2020__EPI_ISL_415147 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13546 - protein, 1273 aa, synthetic construct
  REGION 1..1273: note = SARS-CoV-2/Belgium/VAG-03013/2020__EPI_ISL_415155 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13547 - protein, 1273 aa, synthetic construct
  REGION 1..1273: note = SARS-CoV-2/Belgium/BC-03016/2020__EPI_ISL_415157 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13548 - protein, 1273 aa, synthetic construct
  REGION 1..1273: note = SARS-CoV-2/Germany/BavPat3/2020__EPI_ISL_414521 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13549 - protein, 1273 aa, synthetic construct
  REGION 1..1273: note = SARS-CoV-2/France/HF1805/2020__EPI_ISL_414628 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13550 - protein, 1273 aa, synthetic construct
  REGION 1..1273: note SARS-CoV-2/Netherlands/ZuidHolland_9/2020__EPI_ISL_414445 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13551 - protein, 1273 aa, synthetic construct
  REGION 1..1273: note = SARS-CoV-2/Finland/FIN03032020A/2020__EPI_ISL_413602 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13552 - protein, 1273 aa, synthetic construct
  REGION 1..1273: note = SARS-CoV-2/France/GE1977/2020__EPI_ISL_414632 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13553 - protein, 1273 aa, synthetic construct
  REGION 1..1273: note = SARS-CoV-2/Finland/FIN-313/2020__EPI_ISL_414641 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13554 - protein, 1273 aa, synthetic construct
  REGION 1..1273: note SARS-CoV-2/Netherlands/ZuidHolland_2/2020__EPI_ISL_414556 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13555 - protein, 1273 aa, synthetic construct
  REGION 1..1273: note = SARS-CoV-2/USA/WA-UW31/2020__EPI_ISL_414618 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13556 - protein, 1273 aa, synthetic construct
  REGION 1..1273: note = SARS-CoV-2/South Korea/SNU01/2020__EPI_ISL_411929 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13557 - protein, 1273 aa, synthetic construct
  REGION 1..1273: note = SARS-CoV-2/China/WF0004/2020__EPI_ISL_413694 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13558 - protein, 1273 aa, synthetic construct
  REGION 1..1273: note = SARS-CoV-2/China/WF0028/2020__EPI_ISL_413791 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELESFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13559 - protein, 1273 aa, synthetic construct
  REGION 1..1273: note = SARS-CoV-2/2019-nCoV/USA-CruiseA-18/2020__MT159716.1 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13560 - protein, 1273 aa, synthetic construct
  REGION 1..1273: note SARS-CoV-2/SARS-CoV-2/Yunnan-01/human/2020/CHN__MT049951.1 spike protein (1-1273)(N914C_S1123C)
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13561 - protein, 1273 aa, synthetic construct
  REGION 1..1273: note = SARS-CoV-2/USA/WA-UW292/2020__EPI_ISL_418077 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13562 - protein, 1273 aa, synthetic construct
  REGION 1..1273: note = SARS-CoV-2/Iceland/192/2020__EPI_ISL_417819 spike protein (1-1273)(N914C_S1123C)
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13563 - protein, 1273 aa, synthetic construct
  REGION 1..1273: note = SARS-CoV-2/Belgium/ULG-6939/2020__EPI_ISL_417020 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13564 - protein, 1273 aa, synthetic construct
  REGION 1..1273: note = SARS-CoV-2/France/HF2496/2020__EPI_ISL_418231 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13565 - protein, 1273 aa, synthetic construct
  REGION 1..1273: note = SARS-CoV-2/USA/WA-UW291/2020__EPI_ISL_418076 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13566 - protein, 1273 aa, synthetic construct
  REGION 1..1273: note = SARS-CoV-2/Portugal/PT0034/2020__EPI_ISL_418019 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCITSCCSCLKGCCSCGSCCKFDEDDSEPVLKGVKLHYT

SEQ ID NO: 13567 - protein, 1273 aa, synthetic construct
  REGION 1..1273: note = SARS-CoV-2/Iceland/202/2020__EPI_ISL_417750 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDIPGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13568 - protein, 1273 aa, synthetic construct
  REGION 1..1273: note = SARS-CoV-2/USA/WA-UW261/2020__EPI_ISL_418046 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13569 - protein, 1273 aa, synthetic construct
  REGION 1..1273: note = SARS-CoV-2/Portugal/PT0035/2020__EPI_ISL_418020 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13570 - protein, 1273 aa, synthetic construct
  REGION 1..1273: note = SARS-CoV-2/USA/NY-NYUMC7/2020__EPI_ISL_418192 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13571 - protein, 1273 aa, synthetic construct
  REGION 1..1273: note = SARS-CoV-2/Iceland/189/2020__EPI_ISL_417709 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13572 - protein, 1273 aa, synthetic construct
  REGION 1..1273: note = SARS-CoV-2/Australia/NSW56/2020__EPI_ISL_417408 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13573 - protein, 1273 aa, synthetic construct
  REGION 1..1273: note = SARS-CoV-2/Iceland/280/2020__EPI_ISL_417608 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13574 - protein, 1273 aa, synthetic construct
  REGION 1..1273: note = SARS-CoV-2/Iceland/247/2020__EPI_ISL_417575 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 13575 - protein, 1273 aa, synthetic construct
  REGION 1..1273: note = SARS-CoV-2/Iceland/238/2020__EPI_ISL_417566 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13576 - protein, 1273 aa, synthetic construct
  REGION 1..1273: note = SARS-CoV-2/Greece/16/2020__EPI_ISL_418265 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13577 - protein, 1273 aa, synthetic construct
  REGION 1..1273: note = SARS-CoV-2/Iceland/319/2020__EPI_ISL_417648 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13578 - protein, 1273 aa, synthetic construct
  REGION 1..1273: note = SARS-CoV-2/Congo/94/2020__EPI_ISL_417947 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13579 - protein, 1273 aa, synthetic construct
  REGION 1..1273: note = SARS-CoV-2/Congo/158/2020__EPI_ISL_417950 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13580 - protein, 1273 aa, synthetic construct
  REGION 1..1273: note = SARS-CoV-2/USA/UT-00034/2020__EPI_ISL_417977 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13581 - protein, 1273 aa, synthetic construct
  REGION 1..1273: note = SARS-CoV-2/USA/UT-00033/2020__EPI_ISL_417976 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13582 - protein, 1273 aa, synthetic construct
  REGION 1..1273: note = SARS-CoV-2/USA/WI-13/2020__EPI_ISL_417516 spike protein (1-1273)(N914C_S1123C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13583 - protein, 1272 aa, synthetic construct
  REGION 1..1272: note = SARS-CoV-2/India/1-27/2020__EPI_ISL_413522 spike protein (1-1273)(N913C_S1122C)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 13584 - protein, 1267 aa, synthetic construct
  REGION 1..1267: note = SARS-CoV-2/pangolin/Guangxi/P4L/2017__EPI_ISL_410538 spike protein (1-1273)(N908C_S1117C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESPIDLQELGKYEQYIKWPWYIWLGFIAGLIAIIMVTIMLCCMTSCCSCLKGCCSCGSCCKFDEDDSEPVLKGVKLHYT

SEQ ID NO: 13585 - protein, 1267 aa, synthetic construct
  REGION 1..1267: note = SARS-CoV-2/pangolin/Guangxi/P5L/2017__EPI_ISL_410540 spike protein (1-1273)(N908C_S1117C)
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 13586 - protein, 1267 aa, synthetic construct
  REGION 1..1267: note = SARS-CoV-2/pangolin/Guangxi/P5E/2017__EPI_ISL_410541 spike protein (1-1273)(N908C_S1117C)
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 13587 - protein, 1265 aa, synthetic construct
  REGION 1..1265: note = SARS-CoV-2/pangolin/Guangxi/P1E/2017__EPI_ISL_410539 spike protein (1-1273)(N906C_S1115C)
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIIMVTIMLCCMTSCCSCLKGCCSCGSCCKFDEDDSEPVLKGVKLHYT

SEQ ID NO: 13588 - protein, 1371 aa, synthetic construct
  REGION 1..1371: note = SARS-CoV-2/Wuhan/WIV05/2019__EPI_ISL_402128 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13589 - protein, 1367 aa, synthetic construct
  REGION 1..1367: note = SARS-CoV-2/bat/Yunnan/RaTG13/2013__EPI_ISL_402131 spike protein (1-1207)(N910C_S1119C) LumSynth construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13590 - protein, 1371 aa, synthetic construct
  REGION 1..1371: note = SARS-CoV-2/Wuhan/HBCDC-HB-01/2019__EPI_ISL_402132 spike protein (1-1211)(N914C_S1123C) LumSynth construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13591 - protein, 1371 aa, synthetic construct
  REGION 1..1371: note = SARS-CoV-2/Guangdong/20SF028/2020__EPI_ISL_403936 spike protein (1-1211)(N914C_S1123C) LumSynth construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13592 - protein, 1371 aa, synthetic construct
  REGION 1..1371: note = SARS-CoV-2/Shenzhen/SZTH-001/2020__EPI_ISL_406592 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13593 - protein, 1371 aa, synthetic construct
  REGION 1..1371: note = SARS-CoV-2/Shenzhen/SZTH-004/2020__EPI_ISL_406595 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13594 - protein, 1371 aa, synthetic construct
  REGION 1..1371: note = SARS-CoV-2/France/IDF0372/2020__EPI_ISL_406596 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13595 - protein, 1371 aa, synthetic construct
  REGION 1..1371: note = SARS-CoV-2/Australia/VIC01/2020__EPI_ISL_406844 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13596 - protein, 1371 aa, synthetic construct
  REGION 1..1371: note = SARS-CoV-2/Germany/BavPat1/2020__EPI_ISL_406862 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13597 - protein, 1371 aa, synthetic construct
  REGION 1..1371: note = SARS-CoV-2/Wuhan/HBCDC-HB-02/2020__EPI_ISL_412978 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13598 - protein, 1371 aa, synthetic construct
  REGION 1..1371: note = SARS-CoV-2/Australia/QLD02/2020__EPI_ISL_407896 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13599 - protein, 1371 aa, synthetic construct
  REGION 1..1371: note = SARS-CoV-2/India/1-31/2020__EPI_ISL_413523 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13600 - protein, 1371 aa, synthetic construct
  REGION 1..1371: note SARS-CoV-2/Guangdong/GD2020087-P0008/2020__EPI_ISL_413863 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13601 - protein, 1371 aa, synthetic construct
  REGION 1..1371: note = SARS-CoV-2/Sweden/01/2020__EPI_ISL_411951 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13602 - protein, 1371 aa, synthetic construct
  REGION 1..1371: note = SARS-CoV-2/Tianmen/HBCDC-HB-07/2020__EPI_ISL_412983 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13603 - protein, 1371 aa, synthetic construct
  REGION 1..1371: note = SARS-CoV-2/Hong Kong/case42_VM20002493/2020__EPI_ISL_414527 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13604 - protein, 1371 aa, synthetic construct
  REGION 1..1371: note = SARS-CoV-2/USA/CruiseA-23/2020__EPI_ISL_414482 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13605 - protein, 1371 aa, synthetic construct
  REGION 1..1371: note = SARS-CoV-2/Hong Kong/case85_VM20002868/2020__EPI_ISL_414519 spike protein (1-1211)(N914C_S1123C) LumSynth construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13606 - protein, 1371 aa, synthetic construct; identical to SEQ ID NO: 13596
  REGION 1..1371: note = SARS-CoV-2/England/200990660/2020__EPI_ISL_414523 spike protein (1-1211)(N914C_S1123C) LumSynth construct

SEQ ID NO: 13607 - protein, 1371 aa, synthetic construct
  REGION 1..1371: note = SARS-CoV-2/Australia/NSW09/2020__EPI_ISL_413595 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13608 - protein, 1371 aa, synthetic construct; identical to SEQ ID NO: 13588
  REGION 1..1371: note = SARS-CoV-2/Australia/NSW10/2020__EPI_ISL_413596 spike protein (1-1211)(N914C_S1123C) LumSynth construct

SEQ ID NO: 13609 - protein, 1371 aa, synthetic construct
  REGION 1..1371: note SARS-CoV-2/Switzerland/1000477797/2020__EPI_ISL_413023 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13610 - protein, 1371 aa, synthetic construct
  REGION 1..1371: note = SARS-CoV-2/Belgium/BA-02291/2020__EPI_ISL_415159 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13611 - protein, 1371 aa, synthetic construct
  REGION 1..1371: note = SARS-CoV-2/USA/WA8-UW5/2020__EPI_ISL_413486 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13612 - protein, 1371 aa, synthetic construct
  REGION 1..1371: note = SARS-CoV-2/England/20102000506/2020__EPI_ISL_415147 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13613 - protein, 1371 aa, synthetic construct
  REGION 1..1371: note = SARS-CoV-2/Belgium/VAG-03013/2020__EPI_ISL_415155 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13614 - protein, 1371 aa, synthetic construct
  REGION 1..1371: note = SARS-CoV-2/Belgium/BC-03016/2020__EPI_ISL_415157 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13615 - protein, 1371 aa, synthetic construct
  REGION 1..1371: note = SARS-CoV-2/Germany/BavPat3/2020__EPI_ISL_414521 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13616 - protein, 1371 aa, synthetic construct
  REGION 1..1371: note = SARS-CoV-2/France/HF1805/2020__EPI_ISL_414628 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13617 - protein, 1371 aa, synthetic construct
  REGION 1..1371: note SARS-CoV-2/Netherlands/ZuidHolland_9/2020__EPI_ISL_414445 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13618 - protein, 1371 aa, synthetic construct
  REGION 1..1371: note = SARS-CoV-2/Finland/FIN03032020A/2020__EPI_ISL_413602 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13619 - protein, 1371 aa, synthetic construct
  REGION 1..1371: note = SARS-CoV-2/France/GE1977/2020__EPI_ISL_414632 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13620 - protein, 1371 aa, synthetic construct
  REGION 1..1371: note = SARS-CoV-2/Finland/FIN-313/2020__EPI_ISL_414641 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13621 - protein, 1371 aa, synthetic construct
  REGION 1..1371: note SARS-CoV-2/Netherlands/ZuidHolland_2/2020__EPI_ISL_414556 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13622 - protein, 1371 aa, synthetic construct
  REGION 1..1371: note = SARS-CoV-2/USA/WA-UW31/2020__EPI_ISL_414618 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13623 - protein, 1371 aa, synthetic construct
  REGION 1..1371: note = SARS-CoV-2/South Korea/SNU01/2020__EPI_ISL_411929 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13624 - protein, 1371 aa, synthetic construct
  REGION 1..1371: note = SARS-CoV-2/China/WF0004/2020__EPI_ISL_413694 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13625 - protein, 1371 aa, synthetic construct
  REGION 1..1371: note = SARS-CoV-2/China/WF0028/2020__EPI_ISL_413791 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELESFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13626 - protein, 1371 aa, synthetic construct
  REGION 1..1371: note = SARS-CoV-2/2019-nCoV/USA-CruiseA-18/2020__MT159716.1 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13627 - protein, 1371 aa, synthetic construct
  REGION 1..1371: note SARS-CoV-2/SARS-CoV-2/Yunnan-01/human/2020/CHN__MT049951.1 spike protein (1-1211)(N914C_S1123C) LumSynth construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13628 - protein, 1371 aa, synthetic construct
  REGION 1..1371: note = SARS-CoV-2/USA/WA-UW292/2020__EPI_ISL_418077 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13629 - protein, 1371 aa, synthetic construct
  REGION 1..1371: note = SARS-CoV-2/Iceland/192/2020__EPI_ISL_417819 spike protein (1-1211)(N914C_S1123C) LumSynth construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13630 - protein, 1371 aa, synthetic construct
  REGION 1..1371: note = SARS-CoV-2/Belgium/ULG-6939/2020__EPI_ISL_417020 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13631 - protein, 1371 aa, synthetic construct
  REGION 1..1371: note = SARS-CoV-2/France/HF2496/2020__EPI_ISL_418231 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13632 - protein, 1371 aa, synthetic construct
  REGION 1..1371: note = SARS-CoV-2/USA/WA-UW291/2020__EPI_ISL_418076 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13633 - protein, 1371 aa, synthetic construct; identical to SEQ ID NO: 13596
  REGION 1..1371: note = SARS-CoV-2/Portugal/PT0034/2020__EPI_ISL_418019 spike protein (1-1211)(N914C_S1123C) LumSynth construct

SEQ ID NO: 13634 - protein, 1371 aa, synthetic construct
  REGION 1..1371: note = SARS-CoV-2/Iceland/202/2020__EPI_ISL_417750 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDIPGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13635 - protein, 1371 aa, synthetic construct
  REGION 1..1371: note = SARS-CoV-2/USA/WA-UW261/2020__EPI_ISL_418046 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13636 - protein, 1371 aa, synthetic construct
  REGION 1..1371: note = SARS-CoV-2/Portugal/PT0035/2020__EPI_ISL_418020 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13637 - protein, 1371 aa, synthetic construct
  REGION 1..1371: note = SARS-CoV-2/USA/NY-NYUMC7/2020__EPI_ISL_418192 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13638 - protein, 1371 aa, synthetic construct
  REGION 1..1371: note = SARS-CoV-2/Iceland/189/2020__EPI_ISL_417709 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13639 - protein, 1371 aa, synthetic construct
  REGION 1..1371: note = SARS-CoV-2/Australia/NSW56/2020__EPI_ISL_417408 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13640 - protein, 1371 aa, synthetic construct
  REGION 1..1371: note = SARS-CoV-2/Iceland/280/2020__EPI_ISL_417608 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13641 - protein, 1371 aa, synthetic construct; identical to SEQ ID NO: 13596
  REGION 1..1371: note = SARS-CoV-2/Iceland/247/2020__EPI_ISL_417575 spike protein (1-1211)(N914C_S1123C) LumSynth construct

SEQ ID NO: 13642 - protein, 1371 aa, synthetic construct
  REGION 1..1371: note = SARS-CoV-2/Iceland/238/2020__EPI_ISL_417566 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13643 - protein, 1371 aa, synthetic construct
  REGION 1..1371: note = SARS-CoV-2/Greece/16/2020__EPI_ISL_418265 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13644 - protein, 1371 aa, synthetic construct
  REGION 1..1371: note = SARS-CoV-2/Iceland/319/2020__EPI_ISL_417648 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13645 - protein, 1371 aa, synthetic construct
  REGION 1..1371: note = SARS-CoV-2/Congo/94/2020__EPI_ISL_417947 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13646 - protein, 1371 aa, synthetic construct
  REGION 1..1371: note = SARS-CoV-2/Congo/158/2020__EPI_ISL_417950 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13647 - protein, 1371 aa, synthetic construct
  REGION 1..1371: note = SARS-CoV-2/USA/UT-00034/2020__EPI_ISL_417977 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13648 - protein, 1371 aa, synthetic construct
  REGION 1..1371: note = SARS-CoV-2/USA/UT-00033/2020__EPI_ISL_417976 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13649 - protein, 1371 aa, synthetic construct
  REGION 1..1371: note = SARS-CoV-2/USA/WI-13/2020__EPI_ISL_417516 spike protein (1-1211)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13650 - protein, 1370 aa, synthetic construct
  REGION 1..1370: note = SARS-CoV-2/India/1-27/2020__EPI_ISL_413522 spike protein (1-1210)(N913C_S1122C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13651 - protein, 1365 aa, synthetic construct
  REGION 1..1365: note = SARS-CoV-2/pangolin/Guangxi/P4L/2017__EPI_ISL_410538 spike protein (1-1205)(N908C_S1117C) LumSynth construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESPIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13652 - protein, 1365 aa, synthetic construct
  REGION 1..1365: note = SARS-CoV-2/pangolin/Guangxi/P5L/2017__EPI_ISL_410540 spike protein (1-1205)(N908C_S1117C) LumSynth construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13653 - protein, 1365 aa, synthetic construct
  REGION 1..1365: note = SARS-CoV-2/pangolin/Guangxi/P5E/2017__EPI_ISL_410541 spike protein (1-1205)(N908C_S1117C) LumSynth construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13654 - protein, 1363 aa, synthetic construct
  REGION 1..1363: note = SARS-CoV-2/pangolin/Guangxi/P1E/2017__EPI_ISL_410539 spike protein (1-1203)(N906C_S1115C) LumSynth construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13655 - protein, 1379 aa, synthetic construct
  REGION 1..1379: note = SARS-CoV-2/Wuhan/WIV05/2019__EPI_ISL_402128 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13656 - protein, 1375 aa, synthetic construct
  REGION 1..1375: note = SARS-CoV-2/bat/Yunnan/RaTG13/2013__EPI_ISL_402131 spike protein (1-1207)(N910C_S1119C) Ferritin construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13657 - protein, 1379 aa, synthetic construct
  REGION 1..1379: note = SARS-CoV-2/Wuhan/HBCDC-HB-01/2019__EPI_ISL_402132 spike protein (1-1211)(N914C_S1123C) Ferritin construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13658 - protein, 1379 aa, synthetic construct
  REGION 1..1379: note = SARS-CoV-2/Guangdong/20SF028/2020__EPI_ISL_403936 spike protein (1-1211)(N914C_S1123C) Ferritin construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13659 - protein, 1379 aa, synthetic construct
  REGION 1..1379: note = SARS-CoV-2/Shenzhen/SZTH-001/2020__EPI_ISL_406592 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13660 - protein, 1379 aa, synthetic construct
  REGION 1..1379: note = SARS-CoV-2/Shenzhen/SZTH-004/2020__EPI_ISL_406595 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13661 - protein, 1379 aa, synthetic construct
  REGION 1..1379: note = SARS-CoV-2/France/IDF0372/2020__EPI_ISL_406596 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13662 - protein, 1379 aa, synthetic construct
  REGION 1..1379: note = SARS-CoV-2/Australia/VIC01/2020__EPI_ISL_406844 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13663 - protein, 1379 aa, synthetic construct
  REGION 1..1379: note = SARS-CoV-2/Germany/BavPat1/2020__EPI_ISL_406862 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13664 - protein, 1379 aa, synthetic construct
  REGION 1..1379: note = SARS-CoV-2/Wuhan/HBCDC-HB-02/2020__EPI_ISL_412978 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13665 - protein, 1379 aa, synthetic construct
  REGION 1..1379: note = SARS-CoV-2/Australia/QLD02/2020__EPI_ISL_407896 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13666 - protein, 1379 aa, synthetic construct
  REGION 1..1379: note = SARS-CoV-2/India/1-31/2020__EPI_ISL_413523 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13667 - protein, 1379 aa, synthetic construct
  REGION 1..1379: note SARS-CoV-2/Guangdong/GD2020087-P0008/2020__EPI_ISL_413863 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13668 - protein, 1379 aa, synthetic construct
  REGION 1..1379: note = SARS-CoV-2/Sweden/01/2020__EPI_ISL_411951 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13669 - protein, 1379 aa, synthetic construct
  REGION 1..1379: note = SARS-CoV-2/Tianmen/HBCDC-HB-07/2020__EPI_ISL_412983 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13670 - protein, 1379 aa, synthetic construct
  REGION 1..1379: note = SARS-CoV-2/Hong Kong/case42_VM20002493/2020__EPI_ISL_414527 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13671 - protein, 1379 aa, synthetic construct
  REGION 1..1379: note = SARS-CoV-2/USA/CruiseA-23/2020__EPI_ISL_414482 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13672 - protein, 1379 aa, synthetic construct
  REGION 1..1379: note = SARS-CoV-2/Hong Kong/case85_VM20002868/2020__EPI_ISL_414519 spike protein (1-1211)(N914C_S1123C) Ferritin construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13673 - protein, 1379 aa, synthetic construct; identical to SEQ ID NO: 13663
  REGION 1..1379: note = SARS-CoV-2/England/200990660/2020__EPI_ISL_414523 spike protein (1-1211)(N914C_S1123C) Ferritin construct

SEQ ID NO: 13674 - protein, 1379 aa, synthetic construct
  REGION 1..1379: note = SARS-CoV-2/Australia/NSW09/2020__EPI_ISL_413595 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13675 - protein, 1379 aa, synthetic construct; identical to SEQ ID NO: 13655
  REGION 1..1379: note = SARS-CoV-2/Australia/NSW10/2020__EPI_ISL_413596 spike protein (1-1211)(N914C_S1123C) Ferritin construct

SEQ ID NO: 13676 - protein, 1379 aa, synthetic construct
  REGION 1..1379: note SARS-CoV-2/Switzerland/1000477797/2020__EPI_ISL_413023 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13677 - protein, 1379 aa, synthetic construct
  REGION 1..1379: note = SARS-CoV-2/Belgium/BA-02291/2020__EPI_ISL_415159 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13678 - protein, 1379 aa, synthetic construct
  REGION 1..1379: note = SARS-CoV-2/USA/WA8-UW5/2020__EPI_ISL_413486 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13679 - protein, 1379 aa, synthetic construct
  REGION 1..1379: note = SARS-CoV-2/England/20102000506/2020__EPI_ISL_415147 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13680 - protein, 1379 aa, synthetic construct
  REGION 1..1379: note = SARS-CoV-2/Belgium/VAG-03013/2020__EPI_ISL_415155 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13681 - protein, 1379 aa, synthetic construct
  REGION 1..1379: note = SARS-CoV-2/Belgium/BC-03016/2020__EPI_ISL_415157 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13682 - protein, 1379 aa, synthetic construct
  REGION 1..1379: note = SARS-CoV-2/Germany/BavPat3/2020__EPI_ISL_414521 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13683 - protein, 1379 aa, synthetic construct
  REGION 1..1379: note = SARS-CoV-2/France/HF1805/2020__EPI_ISL_414628 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13684 - protein, 1379 aa, synthetic construct
  REGION 1..1379: note SARS-CoV-2/Netherlands/ZuidHolland_9/2020__EPI_ISL_414445 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13685 - protein, 1379 aa, synthetic construct
  REGION 1..1379: note = SARS-CoV-2/Finland/FIN03032020A/2020__EPI_ISL_413602 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13686 - protein, 1379 aa, synthetic construct
  REGION 1..1379: note = SARS-CoV-2/France/GE1977/2020__EPI_ISL_414632 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13687 - protein, 1379 aa, synthetic construct
  REGION 1..1379: note = SARS-CoV-2/Finland/FIN-313/2020__EPI_ISL_414641 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13688 - protein, 1379 aa, synthetic construct
  REGION 1..1379: note SARS-CoV-2/Netherlands/ZuidHolland_2/2020__EPI_ISL_414556 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13689 - protein, 1379 aa, synthetic construct
  REGION 1..1379: note = SARS-CoV-2/USA/WA-UW31/2020__EPI_ISL_414618 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13690 - protein, 1379 aa, synthetic construct
  REGION 1..1379: note = SARS-CoV-2/South Korea/SNU01/2020__EPI_ISL_411929 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13691 - protein, 1379 aa, synthetic construct
  REGION 1..1379: note = SARS-CoV-2/China/WF0004/2020__EPI_ISL_413694 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13692 - protein, 1379 aa, synthetic construct
  REGION 1..1379: note = SARS-CoV-2/China/WF0028/2020__EPI_ISL_413791 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELESFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13693 - protein, 1379 aa, synthetic construct
  REGION 1..1379: note = SARS-CoV-2/2019-nCoV/USA-CruiseA-18/2020__MT159716.1 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13694 - protein, 1379 aa, synthetic construct
  REGION 1..1379: note SARS-CoV-2/SARS-CoV-2/Yunnan-01/human/2020/CHN__MT049951.1 spike protein (1-1211)(N914C_S1123C) Ferritin construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13695 - protein, 1379 aa, synthetic construct
  REGION 1..1379: note = SARS-CoV-2/USA/WA-UW292/2020__EPI_ISL_418077 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13696 - protein, 1379 aa, synthetic construct
  REGION 1..1379: note = SARS-CoV-2/Iceland/192/2020__EPI_ISL_417819 spike protein (1-1211)(N914C_S1123C) Ferritin construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13697 - protein, 1379 aa, synthetic construct
  REGION 1..1379: note = SARS-CoV-2/Belgium/ULG-6939/2020__EPI_ISL_417020 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13698 - protein, 1379 aa, synthetic construct
  REGION 1..1379: note = SARS-CoV-2/France/HF2496/2020__EPI_ISL_418231 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13699 - protein, 1379 aa, synthetic construct
  REGION 1..1379: note = SARS-CoV-2/USA/WA-UW291/2020__EPI_ISL_418076 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13700 - protein, 1379 aa, synthetic construct; identical to SEQ ID NO: 13663
  REGION 1..1379: note = SARS-CoV-2/Portugal/PT0034/2020__EPI_ISL_418019 spike protein (1-1211)(N914C_S1123C) Ferritin construct

SEQ ID NO: 13701 - protein, 1379 aa, synthetic construct
  REGION 1..1379: note = SARS-CoV-2/Iceland/202/2020__EPI_ISL_417750 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDIPGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13702 - protein, 1379 aa, synthetic construct
  REGION 1..1379: note = SARS-CoV-2/USA/WA-UW261/2020__EPI_ISL_418046 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13703 - protein, 1379 aa, synthetic construct
  REGION 1..1379: note = SARS-CoV-2/Portugal/PT0035/2020__EPI_ISL_418020 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13704 - protein, 1379 aa, synthetic construct
  REGION 1..1379: note = SARS-CoV-2/USA/NY-NYUMC7/2020__EPI_ISL_418192 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13705 - protein, 1379 aa, synthetic construct
  REGION 1..1379: note = SARS-CoV-2/Iceland/189/2020__EPI_ISL_417709 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13706 - protein, 1379 aa, synthetic construct
  REGION 1..1379: note = SARS-CoV-2/Australia/NSW56/2020__EPI_ISL_417408 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13707 - protein, 1379 aa, synthetic construct
  REGION 1..1379: note = SARS-CoV-2/Iceland/280/2020__EPI_ISL_417608 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13708 - protein, 1379 aa, synthetic construct; identical to SEQ ID NO: 13663
  REGION 1..1379: note = SARS-CoV-2/Iceland/247/2020__EPI_ISL_417575 spike protein (1-1211)(N914C_S1123C) Ferritin construct

SEQ ID NO: 13709 - protein, 1379 aa, synthetic construct
  REGION 1..1379: note = SARS-CoV-2/Iceland/238/2020__EPI_ISL_417566 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13710 - protein, 1379 aa, synthetic construct
  REGION 1..1379: note = SARS-CoV-2/Greece/16/2020__EPI_ISL_418265 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13711 - protein, 1379 aa, synthetic construct
  REGION 1..1379: note = SARS-CoV-2/Iceland/319/2020__EPI_ISL_417648 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13712 - protein, 1379 aa, synthetic construct
  REGION 1..1379: note = SARS-CoV-2/Congo/94/2020__EPI_ISL_417947 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13713 - protein, 1379 aa, synthetic construct
  REGION 1..1379: note = SARS-CoV-2/Congo/158/2020__EPI_ISL_417950 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13714 - protein, 1379 aa, synthetic construct
  REGION 1..1379: note = SARS-CoV-2/USA/UT-00034/2020__EPI_ISL_417977 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13715 - protein, 1379 aa, synthetic construct
  REGION 1..1379: note = SARS-CoV-2/USA/UT-00033/2020__EPI_ISL_417976 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13716 - protein, 1379 aa, synthetic construct
  REGION 1..1379: note = SARS-CoV-2/USA/WI-13/2020__EPI_ISL_417516 spike protein (1-1211)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13717 - protein, 1378 aa, synthetic construct
  REGION 1..1378: note = SARS-CoV-2/India/1-27/2020__EPI_ISL_413522 spike protein (1-1210)(N913C_S1122C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13718 - protein, 1373 aa, synthetic construct
  REGION 1..1373: note = SARS-CoV-2/pangolin/Guangxi/P4L/2017__EPI_ISL_410538 spike protein (1-1205)(N908C_S1117C) Ferritin construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESPIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13719 - protein, 1373 aa, synthetic construct
  REGION 1..1373: note = SARS-CoV-2/pangolin/Guangxi/P5L/2017__EPI_ISL_410540 spike protein (1-1205)(N908C_S1117C) Ferritin construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13720 - protein, 1373 aa, synthetic construct
  REGION 1..1373: note = SARS-CoV-2/pangolin/Guangxi/P5E/2017__EPI_ISL_410541 spike protein (1-1205)(N908C_S1117C) Ferritin construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13721 - protein, 1371 aa, synthetic construct
  REGION 1..1371: note = SARS-CoV-2/pangolin/Guangxi/P1E/2017__EPI_ISL_410539 spike protein (1-1203)(N906C_S1115C) Ferritin construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13722 - protein, 1241 aa, synthetic construct
  REGION 1..1241: note = SARS-CoV-2/Wuhan/WIV05/2019__EPI_ISL_402128 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13723 - protein, 1237 aa, synthetic construct
  REGION 1..1237: note = SARS-CoV-2/bat/Yunnan/RaTG13/2013__EPI_ISL_402131 spike protein (1-1207)(N910C_S1119C) Foldon construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13724 - protein, 1241 aa, synthetic construct
  REGION 1..1241: note = SARS-CoV-2/Wuhan/HBCDC-HB-01/2019__EPI_ISL_402132 spike protein (1-1211)(N914C_S1123C) Foldon construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13725 - protein, 1241 aa, synthetic construct
  REGION 1..1241: note = SARS-CoV-2/Guangdong/20SF028/2020__EPI_ISL_403936 spike protein (1-1211)(N914C_S1123C) Foldon construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13726 - protein, 1241 aa, synthetic construct
  REGION 1..1241: note = SARS-CoV-2/Shenzhen/SZTH-001/2020__EPI_ISL_406592 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13727 - protein, 1241 aa, synthetic construct
  REGION 1..1241: note = SARS-CoV-2/Shenzhen/SZTH-004/2020__EPI_ISL_406595 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13728 - protein, 1241 aa, synthetic construct
  REGION 1..1241: note = SARS-CoV-2/France/IDF0372/2020__EPI_ISL_406596 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13729 - protein, 1241 aa, synthetic construct
  REGION 1..1241: note = SARS-CoV-2/Australia/VIC01/2020__EPI_ISL_406844 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13730 - protein, 1241 aa, synthetic construct
  REGION 1..1241: note = SARS-CoV-2/Germany/BavPat1/2020__EPI_ISL_406862 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13731 - protein, 1241 aa, synthetic construct
  REGION 1..1241: note = SARS-CoV-2/Wuhan/HBCDC-HB-02/2020__EPI_ISL_412978 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13732 - protein, 1241 aa, synthetic construct
  REGION 1..1241: note = SARS-CoV-2/Australia/QLD02/2020__EPI_ISL_407896 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13733 - protein, 1241 aa, synthetic construct
  REGION 1..1241: note = SARS-CoV-2/India/1-31/2020__EPI_ISL_413523 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13734 - protein, 1241 aa, synthetic construct
  REGION 1..1241: note SARS-CoV-2/Guangdong/GD2020087-P0008/2020__EPI_ISL_413863 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13735 - protein, 1241 aa, synthetic construct
  REGION 1..1241: note = SARS-CoV-2/Sweden/01/2020__EPI_ISL_411951 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13736 - protein, 1241 aa, synthetic construct
  REGION 1..1241: note = SARS-CoV-2/Tianmen/HBCDC-HB-07/2020__EPI_ISL_412983 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13737 - protein, 1241 aa, synthetic construct
  REGION 1..1241: note = SARS-CoV-2/Hong Kong/case42_VM20002493/2020__EPI_ISL_414527 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13738 - protein, 1241 aa, synthetic construct
  REGION 1..1241: note = SARS-CoV-2/USA/CruiseA-23/2020__EPI_ISL_414482 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13739 - protein, 1241 aa, synthetic construct
  REGION 1..1241: note = SARS-CoV-2/Hong Kong/case85_VM20002868/2020__EPI_ISL_414519 spike protein (1-1211)(N914C_S1123C) Foldon construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13740 - protein, 1241 aa, synthetic construct; identical to SEQ ID NO: 13730
  REGION 1..1241: note = SARS-CoV-2/England/200990660/2020__EPI_ISL_414523 spike protein (1-1211)(N914C_S1123C) Foldon construct

SEQ ID NO: 13741 - protein, 1241 aa, synthetic construct
  REGION 1..1241: note = SARS-CoV-2/Australia/NSW09/2020__EPI_ISL_413595 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13742 - protein, 1241 aa, synthetic construct; identical to SEQ ID NO: 13722
  REGION 1..1241: note = SARS-CoV-2/Australia/NSW10/2020__EPI_ISL_413596 spike protein (1-1211)(N914C_S1123C) Foldon construct

SEQ ID NO: 13743 - protein, 1241 aa, synthetic construct
  REGION 1..1241: note SARS-CoV-2/Switzerland/1000477797/2020__EPI_ISL_413023 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13744 - protein, 1241 aa, synthetic construct
  REGION 1..1241: note = SARS-CoV-2/Belgium/BA-02291/2020__EPI_ISL_415159 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13745 - protein, 1241 aa, synthetic construct
  REGION 1..1241: note = SARS-CoV-2/USA/WA8-UW5/2020__EPI_ISL_413486 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13746 - protein, 1241 aa, synthetic construct
  REGION 1..1241: note = SARS-CoV-2/England/20102000506/2020__EPI_ISL_415147 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13747 - protein, 1241 aa, synthetic construct
  REGION 1..1241: note = SARS-CoV-2/Belgium/VAG-03013/2020__EPI_ISL_415155 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13748 - protein, 1241 aa, synthetic construct
  REGION 1..1241: note = SARS-CoV-2/Belgium/BC-03016/2020__EPI_ISL_415157 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13749 - protein, 1241 aa, synthetic construct
  REGION 1..1241: note = SARS-CoV-2/Germany/BavPat3/2020__EPI_ISL_414521 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13750 - protein, 1241 aa, synthetic construct
  REGION 1..1241: note = SARS-CoV-2/France/HF1805/2020__EPI_ISL_414628 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13751 - protein, 1241 aa, synthetic construct
  REGION 1..1241: note SARS-CoV-2/Netherlands/ZuidHolland_9/2020__EPI_ISL_414445 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13752 - protein, 1241 aa, synthetic construct
  REGION 1..1241: note = SARS-CoV-2/Finland/FIN03032020A/2020__EPI_ISL_413602 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13753 - protein, 1241 aa, synthetic construct
  REGION 1..1241: note = SARS-CoV-2/France/GE1977/2020__EPI_ISL_414632 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13754 - protein, 1241 aa, synthetic construct
  REGION 1..1241: note = SARS-CoV-2/Finland/FIN-313/2020__EPI_ISL_414641 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13755 - protein, 1241 aa, synthetic construct
  REGION 1..1241: note SARS-CoV-2/Netherlands/ZuidHolland_2/2020__EPI_ISL_414556 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13756 - protein, 1241 aa, synthetic construct
  REGION 1..1241: note = SARS-CoV-2/USA/WA-UW31/2020__EPI_ISL_414618 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13757 - protein, 1241 aa, synthetic construct
  REGION 1..1241: note = SARS-CoV-2/South Korea/SNU01/2020__EPI_ISL_411929 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13758 - protein, 1241 aa, synthetic construct
  REGION 1..1241: note = SARS-CoV-2/China/WF0004/2020__EPI_ISL_413694 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13759 - protein, 1241 aa, synthetic construct
  REGION 1..1241: note = SARS-CoV-2/China/WF0028/2020__EPI_ISL_413791 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELESFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13760 - protein, 1241 aa, synthetic construct
  REGION 1..1241: note = SARS-CoV-2/2019-nCoV/USA-CruiseA-18/2020__MT159716.1 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13761 - protein, 1241 aa, synthetic construct
  REGION 1..1241: note SARS-CoV-2/SARS-CoV-2/Yunnan-01/human/2020/CHN__MT049951.1 spike protein (1-1211)(N914C_S1123C) Foldon construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13762 - protein, 1241 aa, synthetic construct
  REGION 1..1241: note = SARS-CoV-2/USA/WA-UW292/2020__EPI_ISL_418077 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13763 - protein, 1241 aa, synthetic construct
  REGION 1..1241: note = SARS-CoV-2/Iceland/192/2020__EPI_ISL_417819 spike protein (1-1211)(N914C_S1123C) Foldon construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13764 - protein, 1241 aa, synthetic construct
  REGION 1..1241: note = SARS-CoV-2/Belgium/ULG-6939/2020__EPI_ISL_417020 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13765 - protein, 1241 aa, synthetic construct
  REGION 1..1241: note = SARS-CoV-2/France/HF2496/2020__EPI_ISL_418231 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13766 - protein, 1241 aa, synthetic construct
  REGION 1..1241: note = SARS-CoV-2/USA/WA-UW291/2020__EPI_ISL_418076 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13767 - protein, 1241 aa, synthetic construct; identical to SEQ ID NO: 13730
  REGION 1..1241: note = SARS-CoV-2/Portugal/PT0034/2020__EPI_ISL_418019 spike protein (1-1211)(N914C_S1123C) Foldon construct

SEQ ID NO: 13768 - protein, 1241 aa, synthetic construct
  REGION 1..1241: note = SARS-CoV-2/Iceland/202/2020__EPI_ISL_417750 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDIPGINASVVNIQKEIDRLNEVAKNLNESLIDLQELGKYEQYIKGGSGYIPEAPRDGQAYVRKDGEWVLLSTFL

SEQ ID NO: 13769 - protein, 1241 aa, synthetic construct
  REGION 1..1241: note = SARS-CoV-2/USA/WA-UW261/2020__EPI_ISL_418046 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13770 - protein, 1241 aa, synthetic construct
  REGION 1..1241: note = SARS-CoV-2/Portugal/PT0035/2020__EPI_ISL_418020 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13771 - protein, 1241 aa, synthetic construct
  REGION 1..1241: note = SARS-CoV-2/USA/NY-NYUMC7/2020__EPI_ISL_418192 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13772 - protein, 1241 aa, synthetic construct
  REGION 1..1241: note = SARS-CoV-2/Iceland/189/2020__EPI_ISL_417709 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13773 - protein, 1241 aa, synthetic construct
  REGION 1..1241: note = SARS-CoV-2/Australia/NSW56/2020__EPI_ISL_417408 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13774 - protein, 1241 aa, synthetic construct
  REGION 1..1241: note = SARS-CoV-2/Iceland/280/2020__EPI_ISL_417608 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13775 - protein, 1241 aa, synthetic construct; identical to SEQ ID NO: 13730
  REGION 1..1241: note = SARS-CoV-2/Iceland/247/2020__EPI_ISL_417575 spike protein (1-1211)(N914C_S1123C) Foldon construct

SEQ ID NO: 13776 - protein, 1241 aa, synthetic construct
  REGION 1..1241: note = SARS-CoV-2/Iceland/238/2020__EPI_ISL_417566 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13777 - protein, 1241 aa, synthetic construct
  REGION 1..1241: note = SARS-CoV-2/Greece/16/2020__EPI_ISL_418265 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13778 - protein, 1241 aa, synthetic construct
  REGION 1..1241: note = SARS-CoV-2/Iceland/319/2020__EPI_ISL_417648 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13779 - protein, 1241 aa, synthetic construct
  REGION 1..1241: note = SARS-CoV-2/Congo/94/2020__EPI_ISL_417947 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13780 - protein, 1241 aa, synthetic construct
  REGION 1..1241: note = SARS-CoV-2/Congo/158/2020__EPI_ISL_417950 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13781 - protein, 1241 aa, synthetic construct
  REGION 1..1241: note = SARS-CoV-2/USA/UT-00034/2020__EPI_ISL_417977 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13782 - protein, 1241 aa, synthetic construct
  REGION 1..1241: note = SARS-CoV-2/USA/UT-00033/2020__EPI_ISL_417976 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13783 - protein, 1241 aa, synthetic construct
  REGION 1..1241: note = SARS-CoV-2/USA/WI-13/2020__EPI_ISL_417516 spike protein (1-1211)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13784 - protein, 1240 aa, synthetic construct
  REGION 1..1240: note = SARS-CoV-2/India/1-27/2020__EPI_ISL_413522 spike protein (1-1210)(N913C_S1122C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13785 - protein, 1235 aa, synthetic construct
  REGION 1..1235: note = SARS-CoV-2/pangolin/Guangxi/P4L/2017__EPI_ISL_410538 spike protein (1-1205)(N908C_S1117C) Foldon construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESPIDLQELGKYEQYIKGGSGYIPEAPRDGQAYVRKDGEWVLLSTFL

SEQ ID NO: 13786 - protein, 1235 aa, synthetic construct
  REGION 1..1235: note = SARS-CoV-2/pangolin/Guangxi/P5L/2017__EPI_ISL_410540 spike protein (1-1205)(N908C_S1117C) Foldon construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13787 - protein, 1235 aa, synthetic construct
  REGION 1..1235: note = SARS-CoV-2/pangolin/Guangxi/P5E/2017__EPI_ISL_410541 spike protein (1-1205)(N908C_S1117C) Foldon construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13788 - protein, 1233 aa, synthetic construct
  REGION 1..1233: note = SARS-CoV-2/pangolin/Guangxi/P1E/2017__EPI_ISL_410539 spike protein (1-1203)(N906C_S1115C) Foldon construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGSGYIPEAPRDGQAYVRKDGEWVLLSTFL

SEQ ID NO: 13789 - protein, 1365 aa, synthetic construct
  REGION 1..1365: note = SARS-CoV-2/Wuhan/WIV05/2019__EPI_ISL_402128 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13790 - protein, 1361 aa, synthetic construct
  REGION 1..1361: note = SARS-CoV-2/bat/Yunnan/RaTG13/2013__EPI_ISL_402131 spike protein (1-1207)(N910C_S1119C) WhcAg construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13791 - protein, 1365 aa, synthetic construct
  REGION 1..1365: note = SARS-CoV-2/Wuhan/HBCDC-HB-01/2019__EPI_ISL_402132 spike protein (1-1211)(N914C_S1123C) WhcAg construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13792 - protein, 1365 aa, synthetic construct
  REGION 1..1365: note = SARS-CoV-2/Guangdong/20SF028/2020__EPI_ISL_403936 spike protein (1-1211)(N914C_S1123C) WhcAg construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13793 - protein, 1365 aa, synthetic construct
  REGION 1..1365: note = SARS-CoV-2/Shenzhen/SZTH-001/2020__EPI_ISL_406592 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13794 - protein, 1365 aa, synthetic construct
  REGION 1..1365: note = SARS-CoV-2/Shenzhen/SZTH-004/2020__EPI_ISL_406595 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13795 - protein, 1365 aa, synthetic construct
  REGION 1..1365: note = SARS-CoV-2/France/IDF0372/2020__EPI_ISL_406596 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13796 - protein, 1365 aa, synthetic construct
  REGION 1..1365: note = SARS-CoV-2/Australia/VIC01/2020__EPI_ISL_406844 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13797 - protein, 1365 aa, synthetic construct
  REGION 1..1365: note = SARS-CoV-2/Germany/BavPat1/2020__EPI_ISL_406862 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13798 - protein, 1365 aa, synthetic construct
  REGION 1..1365: note = SARS-CoV-2/Wuhan/HBCDC-HB-02/2020__EPI_ISL_412978 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13799 - protein, 1365 aa, synthetic construct
  REGION 1..1365: note = SARS-CoV-2/Australia/QLD02/2020__EPI_ISL_407896 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13800 - protein, 1365 aa, synthetic construct
  REGION 1..1365: note = SARS-CoV-2/India/1-31/2020__EPI_ISL_413523 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13801 - protein, 1365 aa, synthetic construct
  REGION 1..1365: note SARS-CoV-2/Guangdong/GD2020087-P0008/2020__EPI_ISL_413863 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13802 - protein, 1365 aa, synthetic construct
  REGION 1..1365: note = SARS-CoV-2/Sweden/01/2020__EPI_ISL_411951 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13803 - protein, 1365 aa, synthetic construct
  REGION 1..1365: note = SARS-CoV-2/Tianmen/HBCDC-HB-07/2020__EPI_ISL_412983 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13804 - protein, 1365 aa, synthetic construct
  REGION 1..1365: note = SARS-CoV-2/Hong Kong/case42_VM20002493/2020__EPI_ISL_414527 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13805 - protein, 1365 aa, synthetic construct
  REGION 1..1365: note = SARS-CoV-2/USA/CruiseA-23/2020__EPI_ISL_414482 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13806 - protein, 1365 aa, synthetic construct
  REGION 1..1365: note = SARS-CoV-2/Hong Kong/case85_VM20002868/2020__EPI_ISL_414519 spike protein (1-1211)(N914C_S1123C) WhcAg construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13807 - protein, 1365 aa, synthetic construct; identical to SEQ ID NO: 13797
  REGION 1..1365: note = SARS-CoV-2/England/200990660/2020__EPI_ISL_414523 spike protein (1-1211)(N914C_S1123C) WhcAg construct

SEQ ID NO: 13808 - protein, 1365 aa, synthetic construct
  REGION 1..1365: note = SARS-CoV-2/Australia/NSW09/2020__EPI_ISL_413595 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13809 - protein, 1365 aa, synthetic construct; identical to SEQ ID NO: 13789
  REGION 1..1365: note = SARS-CoV-2/Australia/NSW10/2020__EPI_ISL_413596 spike protein (1-1211)(N914C_S1123C) WhcAg construct

SEQ ID NO: 13810 - protein, 1365 aa, synthetic construct
  REGION 1..1365: note SARS-CoV-2/Switzerland/1000477797/2020__EPI_ISL_413023 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13811 - protein, 1365 aa, synthetic construct
  REGION 1..1365: note = SARS-CoV-2/Belgium/BA-02291/2020__EPI_ISL_415159 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13812 - protein, 1365 aa, synthetic construct
  REGION 1..1365: note = SARS-CoV-2/USA/WA8-UW5/2020__EPI_ISL_413486 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13813 - protein, 1365 aa, synthetic construct
  REGION 1..1365: note = SARS-CoV-2/England/20102000506/2020__EPI_ISL_415147 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13814 - protein, 1365 aa, synthetic construct
  REGION 1..1365: note = SARS-CoV-2/Belgium/VAG-03013/2020__EPI_ISL_415155 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13815 - protein, 1365 aa, synthetic construct
  REGION 1..1365: note = SARS-CoV-2/Belgium/BC-03016/2020__EPI_ISL_415157 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13816 - protein, 1365 aa, synthetic construct
  REGION 1..1365: note = SARS-CoV-2/Germany/BavPat3/2020__EPI_ISL_414521 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13817 - protein, 1365 aa, synthetic construct
  REGION 1..1365: note = SARS-CoV-2/France/HF1805/2020__EPI_ISL_414628 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13818 - protein, 1365 aa, synthetic construct
  REGION 1..1365: note SARS-CoV-2/Netherlands/ZuidHolland_9/2020__EPI_ISL_414445 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13819 - protein, 1365 aa, synthetic construct
  REGION 1..1365: note = SARS-CoV-2/Finland/FIN03032020A/2020__EPI_ISL_413602 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13820 - protein, 1365 aa, synthetic construct
  REGION 1..1365: note = SARS-CoV-2/France/GE1977/2020__EPI_ISL_414632 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13821 - protein, 1365 aa, synthetic construct
  REGION 1..1365: note = SARS-CoV-2/Finland/FIN-313/2020__EPI_ISL_414641 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13822 - protein, 1365 aa, synthetic construct
  REGION 1..1365: note SARS-CoV-2/Netherlands/ZuidHolland_2/2020__EPI_ISL_414556 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13823 - protein, 1365 aa, synthetic construct
  REGION 1..1365: note = SARS-CoV-2/USA/WA-UW31/2020__EPI_ISL_414618 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13824 - protein, 1365 aa, synthetic construct
  REGION 1..1365: note = SARS-CoV-2/South Korea/SNU01/2020__EPI_ISL_411929 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13825 - protein, 1365 aa, synthetic construct
  REGION 1..1365: note = SARS-CoV-2/China/WF0004/2020__EPI_ISL_413694 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13826 - protein, 1365 aa, synthetic construct
  REGION 1..1365: note = SARS-CoV-2/China/WF0028/2020__EPI_ISL_413791 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELESFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13827 - protein, 1365 aa, synthetic construct
  REGION 1..1365: note = SARS-CoV-2/2019-nCoV/USA-CruiseA-18/2020__MT159716.1 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13828 - protein, 1365 aa, synthetic construct
  REGION 1..1365: note SARS-CoV-2/SARS-CoV-2/Yunnan-01/human/2020/CHN__MT049951.1 spike protein (1-1211)(N914C_S1123C) WhcAg construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13829 - protein, 1365 aa, synthetic construct
  REGION 1..1365: note = SARS-CoV-2/USA/WA-UW292/2020__EPI_ISL_418077 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13830 - protein, 1365 aa, synthetic construct
  REGION 1..1365: note = SARS-CoV-2/Iceland/192/2020__EPI_ISL_417819 spike protein (1-1211)(N914C_S1123C) WhcAg construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13831 - protein, 1365 aa, synthetic construct
  REGION 1..1365: note = SARS-CoV-2/Belgium/ULG-6939/2020__EPI_ISL_417020 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13832 - protein, 1365 aa, synthetic construct
  REGION 1..1365: note = SARS-CoV-2/France/HF2496/2020__EPI_ISL_418231 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13833 - protein, 1365 aa, synthetic construct
  REGION 1..1365: note = SARS-CoV-2/USA/WA-UW291/2020__EPI_ISL_418076 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13834 - protein, 1365 aa, synthetic construct; identical to SEQ ID NO: 13797
  REGION 1..1365: note = SARS-CoV-2/Portugal/PT0034/2020__EPI_ISL_418019 spike protein (1-1211)(N914C_S1123C) WhcAg construct

SEQ ID NO: 13835 - protein, 1365 aa, synthetic construct
  REGION 1..1365: note = SARS-CoV-2/Iceland/202/2020__EPI_ISL_417750 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDIPGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13836 - protein, 1365 aa, synthetic construct
  REGION 1..1365: note = SARS-CoV-2/USA/WA-UW261/2020__EPI_ISL_418046 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13837 - protein, 1365 aa, synthetic construct
  REGION 1..1365: note = SARS-CoV-2/Portugal/PT0035/2020__EPI_ISL_418020 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13838 - protein, 1365 aa, synthetic construct
  REGION 1..1365: note = SARS-CoV-2/USA/NY-NYUMC7/2020__EPI_ISL_418192 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13839 - protein, 1365 aa, synthetic construct
  REGION 1..1365: note = SARS-CoV-2/Iceland/189/2020__EPI_ISL_417709 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13840 - protein, 1365 aa, synthetic construct
  REGION 1..1365: note = SARS-CoV-2/Australia/NSW56/2020__EPI_ISL_417408 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13841 - protein, 1365 aa, synthetic construct
  REGION 1..1365: note = SARS-CoV-2/Iceland/280/2020__EPI_ISL_417608 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13842 - protein, 1365 aa, synthetic construct; identical to SEQ ID NO: 13797
  REGION 1..1365: note = SARS-CoV-2/Iceland/247/2020__EPI_ISL_417575 spike protein (1-1211)(N914C_S1123C) WhcAg construct

SEQ ID NO: 13843 - protein, 1365 aa, synthetic construct
  REGION 1..1365: note = SARS-CoV-2/Iceland/238/2020__EPI_ISL_417566 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13844 - protein, 1365 aa, synthetic construct
  REGION 1..1365: note = SARS-CoV-2/Greece/16/2020__EPI_ISL_418265 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13845 - protein, 1365 aa, synthetic construct
  REGION 1..1365: note = SARS-CoV-2/Iceland/319/2020__EPI_ISL_417648 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13846 - protein, 1365 aa, synthetic construct
  REGION 1..1365: note = SARS-CoV-2/Congo/94/2020__EPI_ISL_417947 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13847 - protein, 1365 aa, synthetic construct
  REGION 1..1365: note = SARS-CoV-2/Congo/158/2020__EPI_ISL_417950 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13848 - protein, 1365 aa, synthetic construct
  REGION 1..1365: note = SARS-CoV-2/USA/UT-00034/2020__EPI_ISL_417977 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13849 - protein, 1365 aa, synthetic construct
  REGION 1..1365: note = SARS-CoV-2/USA/UT-00033/2020__EPI_ISL_417976 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13850 - protein, 1365 aa, synthetic construct
  REGION 1..1365: note = SARS-CoV-2/USA/WI-13/2020__EPI_ISL_417516 spike protein (1-1211)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13851 - protein, 1364 aa, synthetic construct
  REGION 1..1364: note = SARS-CoV-2/India/1-27/2020__EPI_ISL_413522 spike protein (1-1210)(N913C_S1122C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13852 - protein, 1359 aa, synthetic construct
  REGION 1..1359: note = SARS-CoV-2/pangolin/Guangxi/P4L/2017__EPI_ISL_410538 spike protein (1-1205)(N908C_S1117C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESPIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13853 - protein, 1359 aa, synthetic construct
  REGION 1..1359: note = SARS-CoV-2/pangolin/Guangxi/P5L/2017__EPI_ISL_410540 spike protein (1-1205)(N908C_S1117C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13854 - protein, 1359 aa, synthetic construct
  REGION 1..1359: note = SARS-CoV-2/pangolin/Guangxi/P5E/2017__EPI_ISL_410541 spike protein (1-1205)(N908C_S1117C) WhcAg construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13855 - protein, 1357 aa, synthetic construct
  REGION 1..1357: note = SARS-CoV-2/pangolin/Guangxi/P1E/2017__EPI_ISL_410539 spike protein (1-1203)(N906C_S1115C) WhcAg construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSFKEELDKYFKNHTSPDVDLGDISGINASVVNIQKEIDRLNEVAKNLNESLIDLQELGKYEQYIKGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 13856 - protein, 1307 aa, synthetic construct
  REGION 1..1307: note = SARS-CoV-2/Wuhan/WIV05/2019__EPI_ISL_402128 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13857 - protein, 1303 aa, synthetic construct
  REGION 1..1303: note = SARS-CoV-2/bat/Yunnan/RaTG13/2013__EPI_ISL_402131 spike protein (1-1143)(N910C_S1119C) LumSynth construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13858 - protein, 1307 aa, synthetic construct
  REGION 1..1307: note = SARS-CoV-2/Wuhan/HBCDC-HB-01/2019__EPI_ISL_402132 spike protein (1-1147)(N914C_S1123C) LumSynth construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13859 - protein, 1307 aa, synthetic construct
  REGION 1..1307: note = SARS-CoV-2/Guangdong/20SF028/2020__EPI_ISL_403936 spike protein (1-1147)(N914C_S1123C) LumSynth construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13860 - protein, 1307 aa, synthetic construct
  REGION 1..1307: note = SARS-CoV-2/Shenzhen/SZTH-001/2020__EPI_ISL_406592 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13861 - protein, 1307 aa, synthetic construct
  REGION 1..1307: note = SARS-CoV-2/Shenzhen/SZTH-004/2020__EPI_ISL_406595 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13862 - protein, 1307 aa, synthetic construct
  REGION 1..1307: note = SARS-CoV-2/France/IDF0372/2020__EPI_ISL_406596 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13863 - protein, 1307 aa, synthetic construct
  REGION 1..1307: note = SARS-CoV-2/Australia/VIC01/2020__EPI_ISL_406844 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13864 - protein, 1307 aa, synthetic construct
  REGION 1..1307: note = SARS-CoV-2/Germany/BavPat1/2020__EPI_ISL_406862 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13865 - protein, 1307 aa, synthetic construct
  REGION 1..1307: note = SARS-CoV-2/Wuhan/HBCDC-HB-02/2020__EPI_ISL_412978 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13866 - protein, 1307 aa, synthetic construct
  REGION 1..1307: note = SARS-CoV-2/Australia/QLD02/2020__EPI_ISL_407896 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13867 - protein, 1307 aa, synthetic construct
  REGION 1..1307: note = SARS-CoV-2/India/1-31/2020__EPI_ISL_413523 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13868 - protein, 1307 aa, synthetic construct
  REGION 1..1307: note SARS-CoV-2/Guangdong/GD2020087-P0008/2020__EPI_ISL_413863 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13869 - protein, 1307 aa, synthetic construct
  REGION 1..1307: note = SARS-CoV-2/Sweden/01/2020__EPI_ISL_411951 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13870 - protein, 1307 aa, synthetic construct
  REGION 1..1307: note = SARS-CoV-2/Tianmen/HBCDC-HB-07/2020__EPI_ISL_412983 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13871 - protein, 1307 aa, synthetic construct
  REGION 1..1307: note = SARS-CoV-2/Hong Kong/case42_VM20002493/2020__EPI_ISL_414527 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13872 - protein, 1307 aa, synthetic construct
  REGION 1..1307: note = SARS-CoV-2/USA/CruiseA-23/2020__EPI_ISL_414482 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13873 - protein, 1307 aa, synthetic construct
  REGION 1..1307: note = SARS-CoV-2/Hong Kong/case85_VM20002868/2020__EPI_ISL_414519 spike protein (1-1147)(N914C_S1123C) LumSynth construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13874 - protein, 1307 aa, synthetic construct; identical to SEQ ID NO: 13864
  REGION 1..1307: note = SARS-CoV-2/England/200990660/2020__EPI_ISL_414523 spike protein (1-1147)(N914C_S1123C) LumSynth construct

SEQ ID NO: 13875 - protein, 1307 aa, synthetic construct
  REGION 1..1307: note = SARS-CoV-2/Australia/NSW09/2020__EPI_ISL_413595 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13876 - protein, 1307 aa, synthetic construct; identical to SEQ ID NO: 13856
  REGION 1..1307: note = SARS-CoV-2/Australia/NSW10/2020__EPI_ISL_413596 spike protein (1-1147)(N914C_S1123C) LumSynth construct

SEQ ID NO: 13877 - protein, 1307 aa, synthetic construct
  REGION 1..1307: note SARS-CoV-2/Switzerland/1000477797/2020__EPI_ISL_413023 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13878 - protein, 1307 aa, synthetic construct
  REGION 1..1307: note = SARS-CoV-2/Belgium/BA-02291/2020__EPI_ISL_415159 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13879 - protein, 1307 aa, synthetic construct
  REGION 1..1307: note = SARS-CoV-2/USA/WA8-UW5/2020__EPI_ISL_413486 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13880 - protein, 1307 aa, synthetic construct
  REGION 1..1307: note = SARS-CoV-2/England/20102000506/2020__EPI_ISL_415147 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13881 - protein, 1307 aa, synthetic construct
  REGION 1..1307: note = SARS-CoV-2/Belgium/VAG-03013/2020__EPI_ISL_415155 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13882 - protein, 1307 aa, synthetic construct
  REGION 1..1307: note = SARS-CoV-2/Belgium/BC-03016/2020__EPI_ISL_415157 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13883 - protein, 1307 aa, synthetic construct
  REGION 1..1307: note = SARS-CoV-2/Germany/BavPat3/2020__EPI_ISL_414521 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13884 - protein, 1307 aa, synthetic construct
  REGION 1..1307: note = SARS-CoV-2/France/HF1805/2020__EPI_ISL_414628 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13885 - protein, 1307 aa, synthetic construct
  REGION 1..1307: note SARS-CoV-2/Netherlands/ZuidHolland_9/2020__EPI_ISL_414445 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13886 - protein, 1307 aa, synthetic construct
  REGION 1..1307: note = SARS-CoV-2/Finland/FIN03032020A/2020__EPI_ISL_413602 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13887 - protein, 1307 aa, synthetic construct
  REGION 1..1307: note = SARS-CoV-2/France/GE1977/2020__EPI_ISL_414632 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13888 - protein, 1307 aa, synthetic construct
  REGION 1..1307: note = SARS-CoV-2/Finland/FIN-313/2020__EPI_ISL_414641 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13889 - protein, 1307 aa, synthetic construct
  REGION 1..1307: note SARS-CoV-2/Netherlands/ZuidHolland_2/2020__EPI_ISL_414556 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13890 - protein, 1307 aa, synthetic construct
  REGION 1..1307: note = SARS-CoV-2/USA/WA-UW31/2020__EPI_ISL_414618 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13891 - protein, 1307 aa, synthetic construct
  REGION 1..1307: note = SARS-CoV-2/South Korea/SNU01/2020__EPI_ISL_411929 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13892 - protein, 1307 aa, synthetic construct
  REGION 1..1307: note = SARS-CoV-2/China/WF0004/2020__EPI_ISL_413694 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13893 - protein, 1307 aa, synthetic construct
  REGION 1..1307: note = SARS-CoV-2/China/WF0028/2020__EPI_ISL_413791 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELESGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13894 - protein, 1307 aa, synthetic construct
  REGION 1..1307: note = SARS-CoV-2/2019-nCoV/USA-CruiseA-18/2020__MT159716.1 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13895 - protein, 1307 aa, synthetic construct
  REGION 1..1307: note SARS-CoV-2/SARS-CoV-2/Yunnan-01/human/2020/CHN__MT049951.1 spike protein (1-1147)(N914C_S1123C) LumSynth construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13896 - protein, 1307 aa, synthetic construct
  REGION 1..1307: note = SARS-CoV-2/USA/WA-UW292/2020__EPI_ISL_418077 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13897 - protein, 1307 aa, synthetic construct
  REGION 1..1307: note = SARS-CoV-2/Iceland/192/2020__EPI_ISL_417819 spike protein (1-1147)(N914C_S1123C) LumSynth construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13898 - protein, 1307 aa, synthetic construct
  REGION 1..1307: note = SARS-CoV-2/Belgium/ULG-6939/2020__EPI_ISL_417020 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13899 - protein, 1307 aa, synthetic construct
  REGION 1..1307: note = SARS-CoV-2/France/HF2496/2020__EPI_ISL_418231 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13900 - protein, 1307 aa, synthetic construct
  REGION 1..1307: note = SARS-CoV-2/USA/WA-UW291/2020__EPI_ISL_418076 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13901 - protein, 1307 aa, synthetic construct; identical to SEQ ID NO: 13864
  REGION 1..1307: note = SARS-CoV-2/Portugal/PT0034/2020__EPI_ISL_418019 spike protein (1-1147)(N914C_S1123C) LumSynth construct

SEQ ID NO: 13902 - protein, 1307 aa, synthetic construct; identical to SEQ ID NO: 13856
  REGION 1..1307: note = SARS-CoV-2/Iceland/202/2020__EPI_ISL_417750 spike protein (1-1147)(N914C_S1123C) LumSynth construct

SEQ ID NO: 13903 - protein, 1307 aa, synthetic construct
  REGION 1..1307: note = SARS-CoV-2/USA/WA-UW261/2020__EPI_ISL_418046 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13904 - protein, 1307 aa, synthetic construct
  REGION 1..1307: note = SARS-CoV-2/Portugal/PT0035/2020__EPI_ISL_418020 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13905 - protein, 1307 aa, synthetic construct
  REGION 1..1307: note = SARS-CoV-2/USA/NY-NYUMC7/2020__EPI_ISL_418192 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13906 - protein, 1307 aa, synthetic construct
  REGION 1..1307: note = SARS-CoV-2/Iceland/189/2020__EPI_ISL_417709 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13907 - protein, 1307 aa, synthetic construct
  REGION 1..1307: note = SARS-CoV-2/Australia/NSW56/2020__EPI_ISL_417408 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13908 - protein, 1307 aa, synthetic construct
  REGION 1..1307: note = SARS-CoV-2/Iceland/280/2020__EPI_ISL_417608 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13909 - protein, 1307 aa, synthetic construct; identical to SEQ ID NO: 13864
  REGION 1..1307: note = SARS-CoV-2/Iceland/247/2020__EPI_ISL_417575 spike protein (1-1147)(N914C_S1123C) LumSynth construct

SEQ ID NO: 13910 - protein, 1307 aa, synthetic construct
  REGION 1..1307: note = SARS-CoV-2/Iceland/238/2020__EPI_ISL_417566 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13911 - protein, 1307 aa, synthetic construct
  REGION 1..1307: note = SARS-CoV-2/Greece/16/2020__EPI_ISL_418265 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13912 - protein, 1307 aa, synthetic construct
  REGION 1..1307: note = SARS-CoV-2/Iceland/319/2020__EPI_ISL_417648 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13913 - protein, 1307 aa, synthetic construct
  REGION 1..1307: note = SARS-CoV-2/Congo/94/2020__EPI_ISL_417947 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13914 - protein, 1307 aa, synthetic construct
  REGION 1..1307: note = SARS-CoV-2/Congo/158/2020__EPI_ISL_417950 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13915 - protein, 1307 aa, synthetic construct
  REGION 1..1307: note = SARS-CoV-2/USA/UT-00034/2020__EPI_ISL_417977 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13916 - protein, 1307 aa, synthetic construct
  REGION 1..1307: note = SARS-CoV-2/USA/UT-00033/2020__EPI_ISL_417976 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13917 - protein, 1307 aa, synthetic construct
  REGION 1..1307: note = SARS-CoV-2/USA/WI-13/2020__EPI_ISL_417516 spike protein (1-1147)(N914C_S1123C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13918 - protein, 1306 aa, synthetic construct
  REGION 1..1306: note = SARS-CoV-2/India/1-27/2020__EPI_ISL_413522 spike protein (1-1146)(N913C_S1122C) LumSynth construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13919 - protein, 1301 aa, synthetic construct
  REGION 1..1301: note = SARS-CoV-2/pangolin/Guangxi/P4L/2017__EPI_ISL_410538 spike protein (1-1141)(N908C_S1117C) LumSynth construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13920 - protein, 1301 aa, synthetic construct
  REGION 1..1301: note = SARS-CoV-2/pangolin/Guangxi/P5L/2017__EPI_ISL_410540 spike protein (1-1141)(N908C_S1117C) LumSynth construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13921 - protein, 1301 aa, synthetic construct
  REGION 1..1301: note = SARS-CoV-2/pangolin/Guangxi/P5E/2017__EPI_ISL_410541 spike protein (1-1141)(N908C_S1117C) LumSynth construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13922 - protein, 1299 aa, synthetic construct
  REGION 1..1299: note = SARS-CoV-2/pangolin/Guangxi/P1E/2017__EPI_ISL_410539 spike protein (1-1139)(N906C_S1115C) LumSynth construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGSGGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 13923 - protein, 1315 aa, synthetic construct
  REGION 1..1315: note = SARS-CoV-2/Wuhan/WIV05/2019__EPI_ISL_402128 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13924 - protein, 1311 aa, synthetic construct
  REGION 1..1311: note = SARS-CoV-2/bat/Yunnan/RaTG13/2013__EPI_ISL_402131 spike protein (1-1143)(N910C_S1119C) Ferritin construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13925 - protein, 1315 aa, synthetic construct
  REGION 1..1315: note = SARS-CoV-2/Wuhan/HBCDC-HB-01/2019__EPI_ISL_402132 spike protein (1-1147)(N914C_S1123C) Ferritin construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13926 - protein, 1315 aa, synthetic construct
  REGION 1..1315: note = SARS-CoV-2/Guangdong/20SF028/2020__EPI_ISL_403936 spike protein (1-1147)(N914C_S1123C) Ferritin construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13927 - protein, 1315 aa, synthetic construct
  REGION 1..1315: note = SARS-CoV-2/Shenzhen/SZTH-001/2020__EPI_ISL_406592 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13928 - protein, 1315 aa, synthetic construct
  REGION 1..1315: note = SARS-CoV-2/Shenzhen/SZTH-004/2020__EPI_ISL_406595 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13929 - protein, 1315 aa, synthetic construct
  REGION 1..1315: note = SARS-CoV-2/France/IDF0372/2020__EPI_ISL_406596 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13930 - protein, 1315 aa, synthetic construct
  REGION 1..1315: note = SARS-CoV-2/Australia/VIC01/2020__EPI_ISL_406844 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13931 - protein, 1315 aa, synthetic construct
  REGION 1..1315: note = SARS-CoV-2/Germany/BavPat1/2020__EPI_ISL_406862 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13932 - protein, 1315 aa, synthetic construct
  REGION 1..1315: note = SARS-CoV-2/Wuhan/HBCDC-HB-02/2020__EPI_ISL_412978 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13933 - protein, 1315 aa, synthetic construct
  REGION 1..1315: note = SARS-CoV-2/Australia/QLD02/2020__EPI_ISL_407896 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13934 - protein, 1315 aa, synthetic construct
  REGION 1..1315: note = SARS-CoV-2/India/1-31/2020__EPI_ISL_413523 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13935 - protein, 1315 aa, synthetic construct
  REGION 1..1315: note SARS-CoV-2/Guangdong/GD2020087-P0008/2020__EPI_ISL_413863 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13936 - protein, 1315 aa, synthetic construct
  REGION 1..1315: note = SARS-CoV-2/Sweden/01/2020__EPI_ISL_411951 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13937 - protein, 1315 aa, synthetic construct
  REGION 1..1315: note = SARS-CoV-2/Tianmen/HBCDC-HB-07/2020__EPI_ISL_412983 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13938 - protein, 1315 aa, synthetic construct
  REGION 1..1315: note = SARS-CoV-2/Hong Kong/case42_VM20002493/2020__EPI_ISL_414527 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13939 - protein, 1315 aa, synthetic construct
  REGION 1..1315: note = SARS-CoV-2/USA/CruiseA-23/2020__EPI_ISL_414482 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13940 - protein, 1315 aa, synthetic construct
  REGION 1..1315: note = SARS-CoV-2/Hong Kong/case85_VM20002868/2020__EPI_ISL_414519 spike protein (1-1147)(N914C_S1123C) Ferritin construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13941 - protein, 1315 aa, synthetic construct; identical to SEQ ID NO: 13931
  REGION 1..1315: note = SARS-CoV-2/England/200990660/2020__EPI_ISL_414523 spike protein (1-1147)(N914C_S1123C) Ferritin construct

SEQ ID NO: 13942 - protein, 1315 aa, synthetic construct
  REGION 1..1315: note = SARS-CoV-2/Australia/NSW09/2020__EPI_ISL_413595 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13943 - protein, 1315 aa, synthetic construct; identical to SEQ ID NO: 13923
  REGION 1..1315: note = SARS-CoV-2/Australia/NSW10/2020__EPI_ISL_413596 spike protein (1-1147)(N914C_S1123C) Ferritin construct

SEQ ID NO: 13944 - protein, 1315 aa, synthetic construct
  REGION 1..1315: note SARS-CoV-2/Switzerland/1000477797/2020__EPI_ISL_413023 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13945 - protein, 1315 aa, synthetic construct
  REGION 1..1315: note = SARS-CoV-2/Belgium/BA-02291/2020__EPI_ISL_415159 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13946 - protein, 1315 aa, synthetic construct
  REGION 1..1315: note = SARS-CoV-2/USA/WA8-UW5/2020__EPI_ISL_413486 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13947 - protein, 1315 aa, synthetic construct
  REGION 1..1315: note = SARS-CoV-2/England/20102000506/2020__EPI_ISL_415147 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13948 - protein, 1315 aa, synthetic construct
  REGION 1..1315: note = SARS-CoV-2/Belgium/VAG-03013/2020__EPI_ISL_415155 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13949 - protein, 1315 aa, synthetic construct
  REGION 1..1315: note = SARS-CoV-2/Belgium/BC-03016/2020__EPI_ISL_415157 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13950 - protein, 1315 aa, synthetic construct
  REGION 1..1315: note = SARS-CoV-2/Germany/BavPat3/2020__EPI_ISL_414521 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13951 - protein, 1315 aa, synthetic construct
  REGION 1..1315: note = SARS-CoV-2/France/HF1805/2020__EPI_ISL_414628 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13952 - protein, 1315 aa, synthetic construct
  REGION 1..1315: note SARS-CoV-2/Netherlands/ZuidHolland_9/2020__EPI_ISL_414445 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13953 - protein, 1315 aa, synthetic construct
  REGION 1..1315: note = SARS-CoV-2/Finland/FIN03032020A/2020__EPI_ISL_413602 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13954 - protein, 1315 aa, synthetic construct
  REGION 1..1315: note = SARS-CoV-2/France/GE1977/2020__EPI_ISL_414632 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13955 - protein, 1315 aa, synthetic construct
  REGION 1..1315: note = SARS-CoV-2/Finland/FIN-313/2020__EPI_ISL_414641 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13956 - protein, 1315 aa, synthetic construct
  REGION 1..1315: note SARS-CoV-2/Netherlands/ZuidHolland_2/2020__EPI_ISL_414556 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13957 - protein, 1315 aa, synthetic construct
  REGION 1..1315: note = SARS-CoV-2/USA/WA-UW31/2020__EPI_ISL_414618 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13958 - protein, 1315 aa, synthetic construct
  REGION 1..1315: note = SARS-CoV-2/South Korea/SNU01/2020__EPI_ISL_411929 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13959 - protein, 1315 aa, synthetic construct
  REGION 1..1315: note = SARS-CoV-2/China/WF0004/2020__EPI_ISL_413694 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13960 - protein, 1315 aa, synthetic construct
  REGION 1..1315: note = SARS-CoV-2/China/WF0028/2020__EPI_ISL_413791 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELESGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13961 - protein, 1315 aa, synthetic construct
  REGION 1..1315: note = SARS-CoV-2/2019-nCoV/USA-CruiseA-18/2020__MT159716.1 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13962 - protein, 1315 aa, synthetic construct
  REGION 1..1315: note SARS-CoV-2/SARS-CoV-2/Yunnan-01/human/2020/CHN__MT049951.1 spike protein (1-1147)(N914C_S1123C) Ferritin construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13963 - protein, 1315 aa, synthetic construct
  REGION 1..1315: note = SARS-CoV-2/USA/WA-UW292/2020__EPI_ISL_418077 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13964 - protein, 1315 aa, synthetic construct
  REGION 1..1315: note = SARS-CoV-2/Iceland/192/2020__EPI_ISL_417819 spike protein (1-1147)(N914C_S1123C) Ferritin construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13965 - protein, 1315 aa, synthetic construct
  REGION 1..1315: note = SARS-CoV-2/Belgium/ULG-6939/2020__EPI_ISL_417020 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13966 - protein, 1315 aa, synthetic construct
  REGION 1..1315: note = SARS-CoV-2/France/HF2496/2020__EPI_ISL_418231 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13967 - protein, 1315 aa, synthetic construct
  REGION 1..1315: note = SARS-CoV-2/USA/WA-UW291/2020__EPI_ISL_418076 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13968 - protein, 1315 aa, synthetic construct; identical to SEQ ID NO: 13931
  REGION 1..1315: note = SARS-CoV-2/Portugal/PT0034/2020__EPI_ISL_418019 spike protein (1-1147)(N914C_S1123C) Ferritin construct

SEQ ID NO: 13969 - protein, 1315 aa, synthetic construct; identical to SEQ ID NO: 13923
  REGION 1..1315: note = SARS-CoV-2/Iceland/202/2020__EPI_ISL_417750 spike protein (1-1147)(N914C_S1123C) Ferritin construct

SEQ ID NO: 13970 - protein, 1315 aa, synthetic construct
  REGION 1..1315: note = SARS-CoV-2/USA/WA-UW261/2020__EPI_ISL_418046 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13971 - protein, 1315 aa, synthetic construct
  REGION 1..1315: note = SARS-CoV-2/Portugal/PT0035/2020__EPI_ISL_418020 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13972 - protein, 1315 aa, synthetic construct
  REGION 1..1315: note = SARS-CoV-2/USA/NY-NYUMC7/2020__EPI_ISL_418192 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13973 - protein, 1315 aa, synthetic construct
  REGION 1..1315: note = SARS-CoV-2/Iceland/189/2020__EPI_ISL_417709 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13974 - protein, 1315 aa, synthetic construct
  REGION 1..1315: note = SARS-CoV-2/Australia/NSW56/2020__EPI_ISL_417408 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13975 - protein, 1315 aa, synthetic construct
  REGION 1..1315: note = SARS-CoV-2/Iceland/280/2020__EPI_ISL_417608 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13976 - protein, 1315 aa, synthetic construct; identical to SEQ ID NO: 13931
  REGION 1..1315: note = SARS-CoV-2/Iceland/247/2020__EPI_ISL_417575 spike protein (1-1147)(N914C_S1123C) Ferritin construct

SEQ ID NO: 13977 - protein, 1315 aa, synthetic construct
  REGION 1..1315: note = SARS-CoV-2/Iceland/238/2020__EPI_ISL_417566 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13978 - protein, 1315 aa, synthetic construct
  REGION 1..1315: note = SARS-CoV-2/Greece/16/2020__EPI_ISL_418265 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13979 - protein, 1315 aa, synthetic construct
  REGION 1..1315: note = SARS-CoV-2/Iceland/319/2020__EPI_ISL_417648 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13980 - protein, 1315 aa, synthetic construct
  REGION 1..1315: note = SARS-CoV-2/Congo/94/2020__EPI_ISL_417947 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13981 - protein, 1315 aa, synthetic construct
  REGION 1..1315: note = SARS-CoV-2/Congo/158/2020__EPI_ISL_417950 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13982 - protein, 1315 aa, synthetic construct
  REGION 1..1315: note = SARS-CoV-2/USA/UT-00034/2020__EPI_ISL_417977 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13983 - protein, 1315 aa, synthetic construct
  REGION 1..1315: note = SARS-CoV-2/USA/UT-00033/2020__EPI_ISL_417976 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13984 - protein, 1315 aa, synthetic construct
  REGION 1..1315: note = SARS-CoV-2/USA/WI-13/2020__EPI_ISL_417516 spike protein (1-1147)(N914C_S1123C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13985 - protein, 1314 aa, synthetic construct
  REGION 1..1314: note = SARS-CoV-2/India/1-27/2020__EPI_ISL_413522 spike protein (1-1146)(N913C_S1122C) Ferritin construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13986 - protein, 1309 aa, synthetic construct
  REGION 1..1309: note = SARS-CoV-2/pangolin/Guangxi/P4L/2017__EPI_ISL_410538 spike protein (1-1141)(N908C_S1117C) Ferritin construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13987 - protein, 1309 aa, synthetic construct
  REGION 1..1309: note = SARS-CoV-2/pangolin/Guangxi/P5L/2017__EPI_ISL_410540 spike protein (1-1141)(N908C_S1117C) Ferritin construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13988 - protein, 1309 aa, synthetic construct
  REGION 1..1309: note = SARS-CoV-2/pangolin/Guangxi/P5E/2017__EPI_ISL_410541 spike protein (1-1141)(N908C_S1117C) Ferritin construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13989 - protein, 1307 aa, synthetic construct
  REGION 1..1307: note = SARS-CoV-2/pangolin/Guangxi/P1E/2017__EPI_ISL_410539 spike protein (1-1139)(N906C_S1115C) Ferritin construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 13990 - protein, 1177 aa, synthetic construct
  REGION 1..1177: note = SARS-CoV-2/Wuhan/WIV05/2019__EPI_ISL_402128 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 13991 - protein, 1173 aa, synthetic construct
  REGION 1..1173: note = SARS-CoV-2/bat/Yunnan/RaTG13/2013__EPI_ISL_402131 spike protein (1-1143)(N910C_S1119C) Foldon construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDSGGSGYIPEAPRDGQAYVRKDGEWVLLSTFL

SEQ ID NO: 13992 - protein, 1177 aa, synthetic construct
  REGION 1..1177: note = SARS-CoV-2/Wuhan/HBCDC-HB-01/2019__EPI_ISL_402132 spike protein (1-1147)(N914C_S1123C) Foldon construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 13993 - protein, 1177 aa, synthetic construct
  REGION 1..1177: note = SARS-CoV-2/Guangdong/20SF028/2020__EPI_ISL_403936 spike protein (1-1147)(N914C_S1123C) Foldon construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 13994 - protein, 1177 aa, synthetic construct
  REGION 1..1177: note = SARS-CoV-2/Shenzhen/SZTH-001/2020__EPI_ISL_406592 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDSGGSGYIPEAPRDGQAYVRKDGEWVLLSTFL

SEQ ID NO: 13995 - protein, 1177 aa, synthetic construct
  REGION 1..1177: note = SARS-CoV-2/Shenzhen/SZTH-004/2020__EPI_ISL_406595 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 13996 - protein, 1177 aa, synthetic construct
  REGION 1..1177: note = SARS-CoV-2/France/IDF0372/2020__EPI_ISL_406596 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 13997 - protein, 1177 aa, synthetic construct
  REGION 1..1177: note = SARS-CoV-2/Australia/VIC01/2020__EPI_ISL_406844 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 13998 - protein, 1177 aa, synthetic construct
  REGION 1..1177: note = SARS-CoV-2/Germany/BavPat1/2020__EPI_ISL_406862 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 13999 - protein, 1177 aa, synthetic construct
  REGION 1..1177: note = SARS-CoV-2/Wuhan/HBCDC-HB-02/2020__EPI_ISL_412978 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14000 - protein, 1177 aa, synthetic construct
  REGION 1..1177: note = SARS-CoV-2/Australia/QLD02/2020__EPI_ISL_407896 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDSGGSGYIPEAPRDGQAYVRKDGEWVLLSTFL

SEQ ID NO: 14001 - protein, 1177 aa, synthetic construct
  REGION 1..1177: note = SARS-CoV-2/India/1-31/2020__EPI_ISL_413523 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14002 - protein, 1177 aa, synthetic construct
  REGION 1..1177: note SARS-CoV-2/Guangdong/GD2020087-P0008/2020__EPI_ISL_413863 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14003 - protein, 1177 aa, synthetic construct
  REGION 1..1177: note = SARS-CoV-2/Sweden/01/2020__EPI_ISL_411951 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14004 - protein, 1177 aa, synthetic construct
  REGION 1..1177: note = SARS-CoV-2/Tianmen/HBCDC-HB-07/2020__EPI_ISL_412983 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14005 - protein, 1177 aa, synthetic construct
  REGION 1..1177: note = SARS-CoV-2/Hong Kong/case42_VM20002493/2020__EPI_ISL_414527 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14006 - protein, 1177 aa, synthetic construct
  REGION 1..1177: note = SARS-CoV-2/USA/CruiseA-23/2020__EPI_ISL_414482 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14007 - protein, 1177 aa, synthetic construct
  REGION 1..1177: note = SARS-CoV-2/Hong Kong/case85_VM20002868/2020__EPI_ISL_414519 spike protein (1-1147)(N914C_S1123C) Foldon construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14008 - protein, 1177 aa, synthetic construct; identical to SEQ ID NO: 13998
  REGION 1..1177: note = SARS-CoV-2/England/200990660/2020__EPI_ISL_414523 spike protein (1-1147)(N914C_S1123C) Foldon construct

SEQ ID NO: 14009 - protein, 1177 aa, synthetic construct
  REGION 1..1177: note = SARS-CoV-2/Australia/NSW09/2020__EPI_ISL_413595 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14010 - protein, 1177 aa, synthetic construct; identical to SEQ ID NO: 13990
  REGION 1..1177: note = SARS-CoV-2/Australia/NSW10/2020__EPI_ISL_413596 spike protein (1-1147)(N914C_S1123C) Foldon construct

SEQ ID NO: 14011 - protein, 1177 aa, synthetic construct
  REGION 1..1177: note SARS-CoV-2/Switzerland/1000477797/2020__EPI_ISL_413023 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14012 - protein, 1177 aa, synthetic construct
  REGION 1..1177: note = SARS-CoV-2/Belgium/BA-02291/2020__EPI_ISL_415159 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14013 - protein, 1177 aa, synthetic construct
  REGION 1..1177: note = SARS-CoV-2/USA/WA8-UW5/2020__EPI_ISL_413486 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14014 - protein, 1177 aa, synthetic construct
  REGION 1..1177: note = SARS-CoV-2/England/20102000506/2020__EPI_ISL_415147 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14015 - protein, 1177 aa, synthetic construct
  REGION 1..1177: note = SARS-CoV-2/Belgium/VAG-03013/2020__EPI_ISL_415155 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14016 - protein, 1177 aa, synthetic construct
  REGION 1..1177: note = SARS-CoV-2/Belgium/BC-03016/2020__EPI_ISL_415157 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14017 - protein, 1177 aa, synthetic construct
  REGION 1..1177: note = SARS-CoV-2/Germany/BavPat3/2020__EPI_ISL_414521 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14018 - protein, 1177 aa, synthetic construct
  REGION 1..1177: note = SARS-CoV-2/France/HF1805/2020__EPI_ISL_414628 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDSGGSGYIPEAPRDGQAYVRKDGEWVLLSTFL

SEQ ID NO: 14019 - protein, 1177 aa, synthetic construct
  REGION 1..1177: note SARS-CoV-2/Netherlands/ZuidHolland_9/2020__EPI_ISL_414445 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14020 - protein, 1177 aa, synthetic construct
  REGION 1..1177: note = SARS-CoV-2/Finland/FIN03032020A/2020__EPI_ISL_413602 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14021 - protein, 1177 aa, synthetic construct
  REGION 1..1177: note = SARS-CoV-2/France/GE1977/2020__EPI_ISL_414632 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14022 - protein, 1177 aa, synthetic construct
  REGION 1..1177: note = SARS-CoV-2/Finland/FIN-313/2020__EPI_ISL_414641 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14023 - protein, 1177 aa, synthetic construct
  REGION 1..1177: note SARS-CoV-2/Netherlands/ZuidHolland_2/2020__EPI_ISL_414556 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14024 - protein, 1177 aa, synthetic construct
  REGION 1..1177: note = SARS-CoV-2/USA/WA-UW31/2020__EPI_ISL_414618 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14025 - protein, 1177 aa, synthetic construct
  REGION 1..1177: note = SARS-CoV-2/South Korea/SNU01/2020__EPI_ISL_411929 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14026 - protein, 1177 aa, synthetic construct
  REGION 1..1177: note = SARS-CoV-2/China/WF0004/2020__EPI_ISL_413694 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14027 - protein, 1177 aa, synthetic construct
  REGION 1..1177: note = SARS-CoV-2/China/WF0028/2020__EPI_ISL_413791 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELESGGSGYIPEAPRDGQAYVRKDGEWVLLSTFL

SEQ ID NO: 14028 - protein, 1177 aa, synthetic construct
  REGION 1..1177: note = SARS-CoV-2/2019-nCoV/USA-CruiseA-18/2020__MT159716.1 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14029 - protein, 1177 aa, synthetic construct
  REGION 1..1177: note SARS-CoV-2/SARS-CoV-2/Yunnan-01/human/2020/CHN__MT049951.1 spike protein (1-1147)(N914C_S1123C) Foldon construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14030 - protein, 1177 aa, synthetic construct
  REGION 1..1177: note = SARS-CoV-2/USA/WA-UW292/2020__EPI_ISL_418077 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14031 - protein, 1177 aa, synthetic construct
  REGION 1..1177: note = SARS-CoV-2/Iceland/192/2020__EPI_ISL_417819 spike protein (1-1147)(N914C_S1123C) Foldon construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14032 - protein, 1177 aa, synthetic construct
  REGION 1..1177: note = SARS-CoV-2/Belgium/ULG-6939/2020__EPI_ISL_417020 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14033 - protein, 1177 aa, synthetic construct
  REGION 1..1177: note = SARS-CoV-2/France/HF2496/2020__EPI_ISL_418231 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14034 - protein, 1177 aa, synthetic construct
  REGION 1..1177: note = SARS-CoV-2/USA/WA-UW291/2020__EPI_ISL_418076 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14035 - protein, 1177 aa, synthetic construct; identical to SEQ ID NO: 13998
  REGION 1..1177: note = SARS-CoV-2/Portugal/PT0034/2020__EPI_ISL_418019 spike protein (1-1147)(N914C_S1123C) Foldon construct

SEQ ID NO: 14036 - protein, 1177 aa, synthetic construct; identical to SEQ ID NO: 13990
  REGION 1..1177: note = SARS-CoV-2/Iceland/202/2020__EPI_ISL_417750 spike protein (1-1147)(N914C_S1123C) Foldon construct

SEQ ID NO: 14037 - protein, 1177 aa, synthetic construct
  REGION 1..1177: note = SARS-CoV-2/USA/WA-UW261/2020__EPI_ISL_418046 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14038 - protein, 1177 aa, synthetic construct
  REGION 1..1177: note = SARS-CoV-2/Portugal/PT0035/2020__EPI_ISL_418020 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14039 - protein, 1177 aa, synthetic construct
  REGION 1..1177: note = SARS-CoV-2/USA/NY-NYUMC7/2020__EPI_ISL_418192 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14040 - protein, 1177 aa, synthetic construct
  REGION 1..1177: note = SARS-CoV-2/Iceland/189/2020__EPI_ISL_417709 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14041 - protein, 1177 aa, synthetic construct
  REGION 1..1177: note = SARS-CoV-2/Australia/NSW56/2020__EPI_ISL_417408 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14042 - protein, 1177 aa, synthetic construct
  REGION 1..1177: note = SARS-CoV-2/Iceland/280/2020__EPI_ISL_417608 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14043 - protein, 1177 aa, synthetic construct; identical to SEQ ID NO: 13998
  REGION 1..1177: note = SARS-CoV-2/Iceland/247/2020__EPI_ISL_417575 spike protein (1-1147)(N914C_S1123C) Foldon construct

SEQ ID NO: 14044 - protein, 1177 aa, synthetic construct
  REGION 1..1177: note = SARS-CoV-2/Iceland/238/2020__EPI_ISL_417566 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14045 - protein, 1177 aa, synthetic construct
  REGION 1..1177: note = SARS-CoV-2/Greece/16/2020__EPI_ISL_418265 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14046 - protein, 1177 aa, synthetic construct
  REGION 1..1177: note = SARS-CoV-2/Iceland/319/2020__EPI_ISL_417648 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14047 - protein, 1177 aa, synthetic construct
  REGION 1..1177: note = SARS-CoV-2/Congo/94/2020__EPI_ISL_417947 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14048 - protein, 1177 aa, synthetic construct
  REGION 1..1177: note = SARS-CoV-2/Congo/158/2020__EPI_ISL_417950 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDSGGSGYIPEAPRDGQAYVRKDGEWVLLSTFL

SEQ ID NO: 14049 - protein, 1177 aa, synthetic construct
  REGION 1..1177: note = SARS-CoV-2/USA/UT-00034/2020__EPI_ISL_417977 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14050 - protein, 1177 aa, synthetic construct
  REGION 1..1177: note = SARS-CoV-2/USA/UT-00033/2020__EPI_ISL_417976 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14051 - protein, 1177 aa, synthetic construct
  REGION 1..1177: note = SARS-CoV-2/USA/WI-13/2020__EPI_ISL_417516 spike protein (1-1147)(N914C_S1123C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14052 - protein, 1176 aa, synthetic construct
  REGION 1..1176: note = SARS-CoV-2/India/1-27/2020__EPI_ISL_413522 spike protein (1-1146)(N913C_S1122C) Foldon construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGSGYIPEAPRDGQAYVRKDGEWVLLSTFL

SEQ ID NO: 14053 - protein, 1171 aa, synthetic construct
  REGION 1..1171: note = SARS-CoV-2/pangolin/Guangxi/P4L/2017__EPI_ISL_410538 spike protein (1-1141)(N908C_S1117C) Foldon construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGSGYIPEAPRDGQAYVRKDGEWVLLSTFL

SEQ ID NO: 14054 - protein, 1171 aa, synthetic construct
  REGION 1..1171: note = SARS-CoV-2/pangolin/Guangxi/P5L/2017__EPI_ISL_410540 spike protein (1-1141)(N908C_S1117C) Foldon construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGSGYIPEAPRDGQAYVRKDGEWVLLSTFL

SEQ ID NO: 14055 - protein, 1171 aa, synthetic construct
  REGION 1..1171: note = SARS-CoV-2/pangolin/Guangxi/P5E/2017__EPI_ISL_410541 spike protein (1-1141)(N908C_S1117C) Foldon construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGSGYIPEAPRDGQAYVRKDGEWVLLSTFL

SEQ ID NO: 14056 - protein, 1169 aa, synthetic construct
  REGION 1..1169: note = SARS-CoV-2/pangolin/Guangxi/P1E/2017__EPI_ISL_410539 spike protein (1-1139)(N906C_S1115C) Foldon construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGSGYIPEAPRDGQAYVRKDGEWVLLSTFL

SEQ ID NO: 14057 - protein, 1301 aa, synthetic construct
  REGION 1..1301: note = SARS-CoV-2/Wuhan/WIV05/2019__EPI_ISL_402128 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14058 - protein, 1297 aa, synthetic construct
  REGION 1..1297: note = SARS-CoV-2/bat/Yunnan/RaTG13/2013__EPI_ISL_402131 spike protein (1-1143)(N910C_S1119C) WhcAg construct
MFVFLVLLPLVSSQCVNLTTRTQLPPAYTNSSTRGVYYPDKVFRSSVLHLTQDLFLPFFSNVTWFHAIHVSGTNGIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPPGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTDSIVRFPNITNLCPFGEVFNATTFASVYAWNRKRISNCVADYSVLYNSTSFSTFKCYGVSPTKLNDLCFTNVYADSFVITGDEVRQIAPGQTGKIADYNYKLPDDFTGCVIAWNSKHIDAKEGGNFNYLYRLFRKANLKPFERDISTEIYQAGSKPCNGQTGLNCYYPLYRYGFYPTDGVGHQPYRVVVLSFELLNAPATVCGPKKSTNLVKNKCVNFNFNGLTGTGVLTESNKKFLPFQQFGRDIADTTDAVRDPQTLEILDITPCSFGGVSVITPGTNASNQVAVLYQDVNCTEVPVAIHADQLTPTWRVYSTGSNVFQTRAGCLIGAEHVNNSYECDIPIGAGICASYQTQTNSRSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14059 - protein, 1301 aa, synthetic construct
  REGION 1..1301: note = SARS-CoV-2/Wuhan/HBCDC-HB-01/2019__EPI_ISL_402132 spike protein (1-1147)(N914C_S1123C) WhcAg construct
MFVFLVLLPLVSSQCVNLTTRTQLPPAYTNSITRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14060 - protein, 1301 aa, synthetic construct
  REGION 1..1301: note = SARS-CoV-2/Guangdong/20SF028/2020__EPI_ISL_403936 spike protein (1-1147)(N914C_S1123C) WhcAg construct
MFVFLVLLPLVSSQCVNLTTRTQLPPAYTNSFTRGVYYPDKVFRSSVLYSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14061 - protein, 1301 aa, synthetic construct
  REGION 1..1301: note = SARS-CoV-2/Shenzhen/SZTH-001/2020__EPI_ISL_406592 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVLIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14062 - protein, 1301 aa, synthetic construct
  REGION 1..1301: note = SARS-CoV-2/Shenzhen/SZTH-004/2020__EPI_ISL_406595 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWDRKRISNCVAYYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14063 - protein, 1301 aa, synthetic construct
  REGION 1..1301: note = SARS-CoV-2/France/IDF0372/2020__EPI_ISL_406596 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSFLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14064 - protein, 1301 aa, synthetic construct
  REGION 1..1301: note = SARS-CoV-2/Australia/VIC01/2020__EPI_ISL_406844 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRRYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14065 - protein, 1301 aa, synthetic construct
  REGION 1..1301: note = SARS-CoV-2/Germany/BavPat1/2020__EPI_ISL_406862 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14066 - protein, 1301 aa, synthetic construct
  REGION 1..1301: note = SARS-CoV-2/Wuhan/HBCDC-HB-02/2020__EPI_ISL_412978 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNFLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14067 - protein, 1301 aa, synthetic construct
  REGION 1..1301: note = SARS-CoV-2/Australia/QLD02/2020__EPI_ISL_407896 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQLELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14068 - protein, 1301 aa, synthetic construct
  REGION 1..1301: note = SARS-CoV-2/India/1-31/2020__EPI_ISL_413523 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSVIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14069 - protein, 1301 aa, synthetic construct
  REGION 1..1301: note SARS-CoV-2/Guangdong/GD2020087-P0008/2020__EPI_ISL_413863 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVREIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14070 - protein, 1301 aa, synthetic construct
  REGION 1..1301: note = SARS-CoV-2/Sweden/01/2020__EPI_ISL_411951 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDCGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14071 - protein, 1301 aa, synthetic construct
  REGION 1..1301: note = SARS-CoV-2/Tianmen/HBCDC-HB-07/2020__EPI_ISL_412983 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDLNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14072 - protein, 1301 aa, synthetic construct
  REGION 1..1301: note = SARS-CoV-2/Hong Kong/case42_VM20002493/2020__EPI_ISL_414527 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFAISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14073 - protein, 1301 aa, synthetic construct
  REGION 1..1301: note = SARS-CoV-2/USA/CruiseA-23/2020__EPI_ISL_414482 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEVKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14074 - protein, 1301 aa, synthetic construct
  REGION 1..1301: note = SARS-CoV-2/Hong Kong/case85_VM20002868/2020__EPI_ISL_414519 spike protein (1-1147)(N914C_S1123C) WhcAg construct
MFVFLVLVPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14075 - protein, 1301 aa, synthetic construct; identical to SEQ ID NO: 14065
  REGION 1..1301: note = SARS-CoV-2/England/200990660/2020__EPI_ISL_414523 spike protein (1-1147)(N914C_S1123C) WhcAg construct

SEQ ID NO: 14076 - protein, 1301 aa, synthetic construct
  REGION 1..1301: note = SARS-CoV-2/Australia/NSW09/2020__EPI_ISL_413595 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSFTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14077 - protein, 1301 aa, synthetic construct; identical to SEQ ID NO: 14057
  REGION 1..1301: note = SARS-CoV-2/Australia/NSW10/2020__EPI_ISL_413596 spike protein (1-1147)(N914C_S1123C) WhcAg construct

SEQ ID NO: 14078 - protein, 1301 aa, synthetic construct
  REGION 1..1301: note SARS-CoV-2/Switzerland/1000477797/2020__EPI_ISL_413023 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFNIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14079 - protein, 1301 aa, synthetic construct
  REGION 1..1301: note = SARS-CoV-2/Belgium/BA-02291/2020__EPI_ISL_415159 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRRSNLKPFERDISTEIYQAGSTPCNGVEGFNCYFPLQSYGFQPTNGVGYQPYRVVVLSFELLPAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSAAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14080 - protein, 1301 aa, synthetic construct
  REGION 1..1301: note = SARS-CoV-2/USA/WA8-UW5/2020__EPI_ISL_413486 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14081 - protein, 1301 aa, synthetic construct
  REGION 1..1301: note = SARS-CoV-2/England/20102000506/2020__EPI_ISL_415147 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGYCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14082 - protein, 1301 aa, synthetic construct
  REGION 1..1301: note = SARS-CoV-2/Belgium/VAG-03013/2020__EPI_ISL_415155 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTATALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14083 - protein, 1301 aa, synthetic construct
  REGION 1..1301: note = SARS-CoV-2/Belgium/BC-03016/2020__EPI_ISL_415157 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTAPALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14084 - protein, 1301 aa, synthetic construct
  REGION 1..1301: note = SARS-CoV-2/Germany/BavPat3/2020__EPI_ISL_414521 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQQVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14085 - protein, 1301 aa, synthetic construct
  REGION 1..1301: note = SARS-CoV-2/France/HF1805/2020__EPI_ISL_414628 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGVVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14086 - protein, 1301 aa, synthetic construct
  REGION 1..1301: note SARS-CoV-2/Netherlands/ZuidHolland_9/2020__EPI_ISL_414445 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICVQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14087 - protein, 1301 aa, synthetic construct
  REGION 1..1301: note = SARS-CoV-2/Finland/FIN03032020A/2020__EPI_ISL_413602 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVISWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14088 - protein, 1301 aa, synthetic construct
  REGION 1..1301: note = SARS-CoV-2/France/GE1977/2020__EPI_ISL_414632 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLFSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14089 - protein, 1301 aa, synthetic construct
  REGION 1..1301: note = SARS-CoV-2/Finland/FIN-313/2020__EPI_ISL_414641 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFKTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14090 - protein, 1301 aa, synthetic construct
  REGION 1..1301: note SARS-CoV-2/Netherlands/ZuidHolland_2/2020__EPI_ISL_414556 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIALEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14091 - protein, 1301 aa, synthetic construct
  REGION 1..1301: note = SARS-CoV-2/USA/WA-UW31/2020__EPI_ISL_414618 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGAEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14092 - protein, 1301 aa, synthetic construct
  REGION 1..1301: note = SARS-CoV-2/South Korea/SNU01/2020__EPI_ISL_411929 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFWALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14093 - protein, 1301 aa, synthetic construct
  REGION 1..1301: note = SARS-CoV-2/China/WF0004/2020__EPI_ISL_413694 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWTESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRFDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14094 - protein, 1301 aa, synthetic construct
  REGION 1..1301: note = SARS-CoV-2/China/WF0028/2020__EPI_ISL_413791 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELESGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14095 - protein, 1301 aa, synthetic construct
  REGION 1..1301: note = SARS-CoV-2/2019-nCoV/USA-CruiseA-18/2020__MT159716.1 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESELRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14096 - protein, 1301 aa, synthetic construct
  REGION 1..1301: note SARS-CoV-2/SARS-CoV-2/Yunnan-01/human/2020/CHN__MT049951.1 spike protein (1-1147)(N914C_S1123C) WhcAg construct
MFVFLVLLPLVSSQCVNLTTRTQLPPANTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14097 - protein, 1301 aa, synthetic construct
  REGION 1..1301: note = SARS-CoV-2/USA/WA-UW292/2020__EPI_ISL_418077 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQASSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14098 - protein, 1301 aa, synthetic construct
  REGION 1..1301: note = SARS-CoV-2/Iceland/192/2020__EPI_ISL_417819 spike protein (1-1147)(N914C_S1123C) WhcAg construct
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14099 - protein, 1301 aa, synthetic construct
  REGION 1..1301: note = SARS-CoV-2/Belgium/ULG-6939/2020__EPI_ISL_417020 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVVYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14100 - protein, 1301 aa, synthetic construct
  REGION 1..1301: note = SARS-CoV-2/France/HF2496/2020__EPI_ISL_418231 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIVARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14101 - protein, 1301 aa, synthetic construct
  REGION 1..1301: note = SARS-CoV-2/USA/WA-UW291/2020__EPI_ISL_418076 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQYSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14102 - protein, 1301 aa, synthetic construct; identical to SEQ ID NO: 14065
  REGION 1..1301: note = SARS-CoV-2/Portugal/PT0034/2020__EPI_ISL_418019 spike protein (1-1147)(N914C_S1123C) WhcAg construct

SEQ ID NO: 14103 - protein, 1301 aa, synthetic construct; identical to SEQ ID NO: 14057
  REGION 1..1301: note = SARS-CoV-2/Iceland/202/2020__EPI_ISL_417750 spike protein (1-1147)(N914C_S1123C) WhcAg construct

SEQ ID NO: 14104 - protein, 1301 aa, synthetic construct
  REGION 1..1301: note = SARS-CoV-2/USA/WA-UW261/2020__EPI_ISL_418046 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFTSVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14105 - protein, 1301 aa, synthetic construct
  REGION 1..1301: note = SARS-CoV-2/Portugal/PT0035/2020__EPI_ISL_418020 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDISARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14106 - protein, 1301 aa, synthetic construct
  REGION 1..1301: note = SARS-CoV-2/USA/NY-NYUMC7/2020__EPI_ISL_418192 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14107 - protein, 1301 aa, synthetic construct
  REGION 1..1301: note = SARS-CoV-2/Iceland/189/2020__EPI_ISL_417709 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFTKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14108 - protein, 1301 aa, synthetic construct
  REGION 1..1301: note = SARS-CoV-2/Australia/NSW56/2020__EPI_ISL_417408 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDSSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14109 - protein, 1301 aa, synthetic construct
  REGION 1..1301: note = SARS-CoV-2/Iceland/280/2020__EPI_ISL_417608 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYHTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14110 - protein, 1301 aa, synthetic construct; identical to SEQ ID NO: 14065
  REGION 1..1301: note = SARS-CoV-2/Iceland/247/2020__EPI_ISL_417575 spike protein (1-1147)(N914C_S1123C) WhcAg construct

SEQ ID NO: 14111 - protein, 1301 aa, synthetic construct
  REGION 1..1301: note = SARS-CoV-2/Iceland/238/2020__EPI_ISL_417566 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADVGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14112 - protein, 1301 aa, synthetic construct
  REGION 1..1301: note = SARS-CoV-2/Greece/16/2020__EPI_ISL_418265 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNVDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14113 - protein, 1301 aa, synthetic construct
  REGION 1..1301: note = SARS-CoV-2/Iceland/319/2020__EPI_ISL_417648 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLIDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14114 - protein, 1301 aa, synthetic construct
  REGION 1..1301: note = SARS-CoV-2/Congo/94/2020__EPI_ISL_417947 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDILFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14115 - protein, 1301 aa, synthetic construct
  REGION 1..1301: note = SARS-CoV-2/Congo/158/2020__EPI_ISL_417950 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFLCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14116 - protein, 1301 aa, synthetic construct
  REGION 1..1301: note = SARS-CoV-2/USA/UT-00034/2020__EPI_ISL_417977 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYYKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14117 - protein, 1301 aa, synthetic construct
  REGION 1..1301: note = SARS-CoV-2/USA/UT-00033/2020__EPI_ISL_417976 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGLTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14118 - protein, 1301 aa, synthetic construct
  REGION 1..1301: note = SARS-CoV-2/USA/WI-13/2020__EPI_ISL_417516 spike protein (1-1147)(N914C_S1123C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVLPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14119 - protein, 1300 aa, synthetic construct
  REGION 1..1300: note = SARS-CoV-2/India/1-27/2020__EPI_ISL_413522 spike protein (1-1146)(N913C_S1122C) WhcAg construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVIQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVCGNCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14120 - protein, 1295 aa, synthetic construct
  REGION 1..1295: note = SARS-CoV-2/pangolin/Guangxi/P4L/2017__EPI_ISL_410538 spike protein (1-1141)(N908C_S1117C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGNLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14121 - protein, 1295 aa, synthetic construct
  REGION 1..1295: note = SARS-CoV-2/pangolin/Guangxi/P5L/2017__EPI_ISL_410540 spike protein (1-1141)(N908C_S1117C) WhcAg construct
MFVFLFVLPLVSSQCVNLTTRTGIPPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14122 - protein, 1295 aa, synthetic construct
  REGION 1..1295: note = SARS-CoV-2/pangolin/Guangxi/P5E/2017__EPI_ISL_410541 spike protein (1-1141)(N908C_S1117C) WhcAg construct
MFVFLFVLPLVSSQCVNLTTRTGIPPGYTNSSTRGVYYPDKVFRSSILHLTQDLFLPFFSNVTWFNTITYQGGSKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGDNYGYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSFRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14123 - protein, 1293 aa, synthetic construct
  REGION 1..1293: note = SARS-CoV-2/pangolin/Guangxi/P1E/2017__EPI_ISL_410539 spike protein (1-1139)(N906C_S1115C) WhcAg construct
MFVFLFVLPLVSSQCVNLTTRTGIQPGYTNSSTRGVYYPDKVFRSSILHLTQDLFLPFFSNVTWFNTINYQGGFKKFDNPVLPFNDGVYFASTEKSNIIRGWIFGTTLDARTQSLLIVNNATNVVIKVCEFQFCTDPFLGVYYHNNNKTWVENEFRVYSSANNCTFEYISQPFLMDLEGKQGNFKNLREFVFKNVDGYFKIYSKHTPIDLVRDLPRGFAALEPLVDLPIGINITRFQTLLALHRSYLTPGKLESGWTTGAAAYYVGYLQQRTFLLSYNQNGTITDAVDCSLDPLSETKCTLKSLTVEKGIYQTSNFRVQPTISIVRFPNITNLCPFGEVFNASKFASVYAWNRKRISNCVADYSVLYNSTSFSTFKCYGVSPTKLNDLCFTNVYADSFVVKGDEVRQIAPGQTGVIADYNYKLPDDFTGCVIAWNSVKQDALTGGNYLYRLFRKSKLKPFERDISTEIYQAGSTPCNGQVGLNCYYPLERYGFHPTTGVNYQPFRVVVLSFELLNGPATVCGPKLSTTLVKDKCVNFNFNGLTGTGVLTTSKKQFLPFQQFGRDISDTTDAVRDPQTLEILDITPCSFGGVSVITPGTNTSNQVAVLYQDVNCTEVPMAIHAEQLTPAWRVYSAGANVFQTRAGCLVGAEHVNNSYECDIPVGAGICASYHSMSSLRSVNQRSIIAYTMSLGAENSVAYSNNSIAIPTNFTISVTTEILPVSMTKTSVDCTMYICGDSIECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQCVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHEGKAHFPREGVFVSNGTHWFITQRNFYEPQIITTDNTFVCGSCDVVIGIVNNTVYDPLQPELDSGGGGSDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 14124 - RNA, 3822 nt, synthetic construct
  misc_feature 1..3822: note = SARS-CoV-2/Wuhan/WIV05/2019__EPI_ISL_402128 spike protein CDS gc (1-1273)(N914C_S1123C)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 14125 - RNA, 4116 nt, synthetic construct
  misc_feature 1..4116: note = SARS-CoV-2/Wuhan/WIV05/2019__EPI_ISL_402128 spike protein CDS gc (1-1211)(N914C_S1123C) LumSynth construct
  source 1..4116: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 14126 - RNA, 4140 nt, synthetic construct
  misc_feature 1..4140: note = SARS-CoV-2/Wuhan/WIV05/2019__EPI_ISL_402128 spike protein CDS gc (1-1211)(N914C_S1123C) Ferritin construct
  source 1..4140: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 14127 - RNA, 3726 nt, synthetic construct
  misc_feature 1..3726: note = SARS-CoV-2/Wuhan/WIV05/2019__EPI_ISL_402128 spike protein CDS gc (1-1211)(N914C_S1123C) Foldon construct
  source 1..3726: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtga

SEQ ID NO: 14128 - RNA, 4098 nt, synthetic construct
  misc_feature 1..4098: note = SARS-CoV-2/Wuhan/WIV05/2019__EPI_ISL_402128 spike protein CDS gc (1-1211)(N914C_S1123C) WhcAg construct
  source 1..4098: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 14129 - RNA, 3924 nt, synthetic construct
  misc_feature 1..3924: note = SARS-CoV-2/Wuhan/WIV05/2019__EPI_ISL_402128 spike protein CDS gc (1-1147)(N914C_S1123C) LumSynth construct
  source 1..3924: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 14130 - RNA, 3948 nt, synthetic construct
  misc_feature 1..3948: note = SARS-CoV-2/Wuhan/WIV05/2019__EPI_ISL_402128 spike protein CDS gc (1-1147)(N914C_S1123C) Ferritin construct
  source 1..3948: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 14131 - RNA, 3534 nt, synthetic construct
  misc_feature 1..3534: note = SARS-CoV-2/Wuhan/WIV05/2019__EPI_ISL_402128 spike protein CDS gc (1-1147)(N914C_S1123C) Foldon construct
  source 1..3534: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtga

SEQ ID NO: 14132 - RNA, 3906 nt, synthetic construct
  misc_feature 1..3906: note = SARS-CoV-2/Wuhan/WIV05/2019__EPI_ISL_402128 spike protein CDS gc (1-1147)(N914C_S1123C) WhcAg construct
  source 1..3906: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctga

SEQ ID NO: 14133 - RNA, 3822 nt, synthetic construct
  misc_feature 1..3822: note = SARS-CoV-2/Wuhan/WIV05/2019__EPI_ISL_402128 spike protein CDS gc mod (1-1273)(N914C_S1123C)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 14134 - RNA, 4116 nt, synthetic construct
  misc_feature 1..4116: note = SARS-CoV-2/Wuhan/WIV05/2019__EPI_ISL_402128 spike protein CDS gc mod (1-1211)(N914C_S1123C) LumSynth construct
  source 1..4116: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 14135 - RNA, 4140 nt, synthetic construct
  misc_feature 1..4140: note = SARS-CoV-2/Wuhan/WIV05/2019__EPI_ISL_402128 spike protein CDS gc mod (1-1211)(N914C_S1123C) Ferritin construct
  source 1..4140: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 14136 - RNA, 3726 nt, synthetic construct
  misc_feature 1..3726: note = SARS-CoV-2/Wuhan/WIV05/2019__EPI_ISL_402128 spike protein CDS gc mod (1-1211)(N914C_S1123C) Foldon construct
  source 1..3726: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttga

SEQ ID NO: 14137 - RNA, 4098 nt, synthetic construct
  misc_feature 1..4098: note = SARS-CoV-2/Wuhan/WIV05/2019__EPI_ISL_402128 spike protein CDS gc mod (1-1211)(N914C_S1123C) WhcAg construct
  source 1..4098: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 14138 - RNA, 3924 nt, synthetic construct
  misc_feature 1..3924: note = SARS-CoV-2/Wuhan/WIV05/2019__EPI_ISL_402128 spike protein CDS gc mod (1-1147)(N914C_S1123C) LumSynth construct
  source 1..3924: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtga

SEQ ID NO: 14139 - RNA, 3948 nt, synthetic construct
  misc_feature 1..3948: note = SARS-CoV-2/Wuhan/WIV05/2019__EPI_ISL_402128 spike protein CDS gc mod (1-1147)(N914C_S1123C) Ferritin construct
  source 1..3948: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctga

SEQ ID NO: 14140 - RNA, 3534 nt, synthetic construct
  misc_feature 1..3534: note = SARS-CoV-2/Wuhan/WIV05/2019__EPI_ISL_402128 spike protein CDS gc mod (1-1147)(N914C_S1123C) Foldon construct
  source 1..3534: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttga

SEQ ID NO: 14141 - RNA, 3906 nt, synthetic construct
  misc_feature 1..3906: note = SARS-CoV-2/Wuhan/WIV05/2019__EPI_ISL_402128 spike protein CDS gc mod (1-1147)(N914C_S1123C) WhcAg construct
  source 1..3906: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttga

SEQ ID NO: 14142 - RNA, 4094 nt, synthetic construct
  misc_feature 1..4094: note = SARS-CoV-2/Wuhan/WIV05/2019__EPI_ISL_402128 spike protein mRNA gc (1-1273)(N914C_S1123C)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14143 - RNA, 4388 nt, synthetic construct
  misc_feature 1..4388: note = SARS-CoV-2/Wuhan/WIV05/2019__EPI_ISL_402128 spike protein mRNA gc (1-1211)(N914C_S1123C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14144 - RNA, 4412 nt, synthetic construct
  misc_feature 1..4412: note = SARS-CoV-2/Wuhan/WIV05/2019__EPI_ISL_402128 spike protein mRNA gc (1-1211)(N914C_S1123C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14145 - RNA, 3998 nt, synthetic construct
  misc_feature 1..3998: note = SARS-CoV-2/Wuhan/WIV05/2019__EPI_ISL_402128 spike protein mRNA gc (1-1211)(N914C_S1123C) Foldon construct
  source 1..3998: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14146 - RNA, 4370 nt, synthetic construct
  misc_feature 1..4370: note = SARS-CoV-2/Wuhan/WIV05/2019__EPI_ISL_402128 spike protein mRNA gc (1-1211)(N914C_S1123C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14147 - RNA, 4196 nt, synthetic construct
  misc_feature 1..4196: note = SARS-CoV-2/Wuhan/WIV05/2019__EPI_ISL_402128 spike protein mRNA gc (1-1147)(N914C_S1123C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14148 - RNA, 4220 nt, synthetic construct
  misc_feature 1..4220: note = SARS-CoV-2/Wuhan/WIV05/2019__EPI_ISL_402128 spike protein mRNA gc (1-1147)(N914C_S1123C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14149 - RNA, 3806 nt, synthetic construct
  misc_feature 1..3806: note = SARS-CoV-2/Wuhan/WIV05/2019__EPI_ISL_402128 spike protein mRNA gc (1-1147)(N914C_S1123C) Foldon construct
  source 1..3806: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14150 - RNA, 4178 nt, synthetic construct
  misc_feature 1..4178: note = SARS-CoV-2/Wuhan/WIV05/2019__EPI_ISL_402128 spike protein mRNA gc (1-1147)(N914C_S1123C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14151 - RNA, 4094 nt, synthetic construct
  misc_feature 1..4094: note = SARS-CoV-2/Wuhan/WIV05/2019__EPI_ISL_402128 spike protein mRNA gc mod (1-1273)(N914C_S1123C)
  source 1..4094: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14152 - RNA, 4388 nt, synthetic construct
  misc_feature 1..4388: note = SARS-CoV-2/Wuhan/WIV05/2019__EPI_ISL_402128 spike protein mRNA gc mod (1-1211)(N914C_S1123C) LumSynth construct
  source 1..4388: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14153 - RNA, 4412 nt, synthetic construct
  misc_feature 1..4412: note = SARS-CoV-2/Wuhan/WIV05/2019__EPI_ISL_402128 spike protein mRNA gc mod (1-1211)(N914C_S1123C) Ferritin construct
  source 1..4412: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14154 - RNA, 3998 nt, synthetic construct
  misc_feature 1..3998: note = SARS-CoV-2/Wuhan/WIV05/2019__EPI_ISL_402128 spike protein mRNA gc mod (1-1211)(N914C_S1123C) Foldon construct
  source 1..3998: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14155 - RNA, 4370 nt, synthetic construct
  misc_feature 1..4370: note = SARS-CoV-2/Wuhan/WIV05/2019__EPI_ISL_402128 spike protein mRNA gc mod (1-1211)(N914C_S1123C) WhcAg construct
  source 1..4370: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14156 - RNA, 4196 nt, synthetic construct
  misc_feature 1..4196: note = SARS-CoV-2/Wuhan/WIV05/2019__EPI_ISL_402128 spike protein mRNA gc mod (1-1147)(N914C_S1123C) LumSynth construct
  source 1..4196: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14157 - RNA, 4220 nt, synthetic construct
  misc_feature 1..4220: note = SARS-CoV-2/Wuhan/WIV05/2019__EPI_ISL_402128 spike protein mRNA gc mod (1-1147)(N914C_S1123C) Ferritin construct
  source 1..4220: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14158 - RNA, 3806 nt, synthetic construct
  misc_feature 1..3806: note = SARS-CoV-2/Wuhan/WIV05/2019__EPI_ISL_402128 spike protein mRNA gc mod (1-1147)(N914C_S1123C) Foldon construct
  source 1..3806: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14159 - RNA, 4178 nt, synthetic construct
  misc_feature 1..4178: note = SARS-CoV-2/Wuhan/WIV05/2019__EPI_ISL_402128 spike protein mRNA gc mod (1-1147)(N914C_S1123C) WhcAg construct
  source 1..4178: mol_type = other RNA
aggagagtcccgcagtcggcgtccagcggctctgcttgttcgtgtgtgtgtcgttgcaggccttattcaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14160 - RNA, 4039 nt, synthetic construct
  misc_feature 1..4039: note = SARS-CoV-2/Wuhan/WIV05/2019__EPI_ISL_402128 spike protein mRNA gc (1-1273)(N914C_S1123C)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14161 - RNA, 4333 nt, synthetic construct
  misc_feature 1..4333: note = SARS-CoV-2/Wuhan/WIV05/2019__EPI_ISL_402128 spike protein mRNA gc (1-1211)(N914C_S1123C) LumSynth construct
  source 1..4333: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14162 - RNA, 4357 nt, synthetic construct
  misc_feature 1..4357: note = SARS-CoV-2/Wuhan/WIV05/2019__EPI_ISL_402128 spike protein mRNA gc (1-1211)(N914C_S1123C) Ferritin construct
  source 1..4357: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14163 - RNA, 3943 nt, synthetic construct
  misc_feature 1..3943: note = SARS-CoV-2/Wuhan/WIV05/2019__EPI_ISL_402128 spike protein mRNA gc (1-1211)(N914C_S1123C) Foldon construct
  source 1..3943: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14164 - RNA, 4315 nt, synthetic construct
  misc_feature 1..4315: note = SARS-CoV-2/Wuhan/WIV05/2019__EPI_ISL_402128 spike protein mRNA gc (1-1211)(N914C_S1123C) WhcAg construct
  source 1..4315: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14165 - RNA, 4141 nt, synthetic construct
  misc_feature 1..4141: note = SARS-CoV-2/Wuhan/WIV05/2019__EPI_ISL_402128 spike protein mRNA gc (1-1147)(N914C_S1123C) LumSynth construct
  source 1..4141: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcggcgggagcgggggcgggcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14166 - RNA, 4165 nt, synthetic construct
  misc_feature 1..4165: note = SARS-CoV-2/Wuhan/WIV05/2019__EPI_ISL_402128 spike protein mRNA gc (1-1147)(N914C_S1123C) Ferritin construct
  source 1..4165: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcgggggcgggagcgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14167 - RNA, 3751 nt, synthetic construct
  misc_feature 1..3751: note = SARS-CoV-2/Wuhan/WIV05/2019__EPI_ISL_402128 spike protein mRNA gc (1-1147)(N914C_S1123C) Foldon construct
  source 1..3751: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcgggagcggctacatccccgaggccccgcgcgacgggcaggcctacgtgcggaaggacggcgagtgggtcctgctcagcaccttcctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14168 - RNA, 4123 nt, synthetic construct
  misc_feature 1..4123: note = SARS-CoV-2/Wuhan/WIV05/2019__EPI_ISL_402128 spike protein mRNA gc (1-1147)(N914C_S1123C) WhcAg construct
  source 1..4123: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagtgcgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgtgcggcaactgcgacgtggtcatcggcatcgtgaacaacacggtgtacgaccccctgcagcccgagctggactccggcgggggcgggagcgacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtccgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14169 - RNA, 4039 nt, synthetic construct
  misc_feature 1..4039: note = SARS-CoV-2/Wuhan/WIV05/2019__EPI_ISL_402128 spike protein mRNA gc mod (1-1273)(N914C_S1123C)
  source 1..4039: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14170 - RNA, 4333 nt, synthetic construct
  misc_feature 1..4333: note = SARS-CoV-2/Wuhan/WIV05/2019__EPI_ISL_402128 spike protein mRNA gc mod (1-1211)(N914C_S1123C) LumSynth construct
  source 1..4333: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14171 - RNA, 4357 nt, synthetic construct
  misc_feature 1..4357: note = SARS-CoV-2/Wuhan/WIV05/2019__EPI_ISL_402128 spike protein mRNA gc mod (1-1211)(N914C_S1123C) Ferritin construct
  source 1..4357: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14172 - RNA, 3943 nt, synthetic construct
  misc_feature 1..3943: note = SARS-CoV-2/Wuhan/WIV05/2019__EPI_ISL_402128 spike protein mRNA gc mod (1-1211)(N914C_S1123C) Foldon construct
  source 1..3943: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14173 - RNA, 4315 nt, synthetic construct
  misc_feature 1..4315: note = SARS-CoV-2/Wuhan/WIV05/2019__EPI_ISL_402128 spike protein mRNA gc mod (1-1211)(N914C_S1123C) WhcAg construct
  source 1..4315: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14174 - RNA, 4141 nt, synthetic construct
  misc_feature 1..4141: note = SARS-CoV-2/Wuhan/WIV05/2019__EPI_ISL_402128 spike protein mRNA gc mod (1-1147)(N914C_S1123C) LumSynth construct
  source 1..4141: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggcggaggatctggcggaggacagatctacgagggcaagctgacagccgagggcctgagatttggaatcgtggccagccggttcaatcacgccctggtggatagactggtggaaggcgccatcgatgccattgtcagacacggcggcagagaagaggacatcaccctcgttagagtgcccggctcttgggagattcctgtggctgctggcgagctggcccggaaagaagatatcgacgccgttatcgccatcggcgtgctgatcagaggcgccacacctcacttcgactatatcgccagcgaggtgtccaaaggcctggccgatctgagcctggaactgagaaagcccatcaccttcggcgtgatcaccgctgacacactggaacaggccattgagagagccggcaccaagcacggcaacaaaggatgggaagccgctctgtccgccatcgagatggccaacctgttcaagagcctgcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14175 - RNA, 4165 nt, synthetic construct
  misc_feature 1..4165: note = SARS-CoV-2/Wuhan/WIV05/2019__EPI_ISL_402128 spike protein mRNA gc mod (1-1147)(N914C_S1123C) Ferritin construct
  source 1..4165: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggaggcggaggatctgacatcatcaagctgctgaacgagcaagtgaacaaagagatgcagagcagcaacctgtacatgagcatgagcagctggtgctacacccacagccttgatggcgccggactgttcctgtttgatcacgccgccgaggaatacgagcacgccaagaagctgatcatcttcctgaacgagaacaacgtgcccgtgcagctgaccagcatttctgcccctgagcacaagttcgagggcctgacacagatcttccagaaggcctacgaacacgagcagcacatcagcgagagcatcaacaacatcgtggaccacgccattaagagcaaggatcacgccaccttcaactttctgcagtggtacgtggccgaacagcacgaggaagaggtgctgttcaaggacatcctggacaagatcgagctgatcggcaacgagaaccacggcctgtatctggccgaccagtacgtgaagggaatcgccaagagcagaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14176 - RNA, 3751 nt, synthetic construct
  misc_feature 1..3751: note = SARS-CoV-2/Wuhan/WIV05/2019__EPI_ISL_402128 spike protein mRNA gc mod (1-1147)(N914C_S1123C) Foldon construct
  source 1..3751: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggaggatctggctatatccccgaggctcctagagatggccaggcctatgttcggaaggatggcgaatgggtgctgctgagcaccttcctttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14177 - RNA, 4123 nt, synthetic construct
  misc_feature 1..4123: note = SARS-CoV-2/Wuhan/WIV05/2019__EPI_ISL_402128 spike protein mRNA gc mod (1-1147)(N914C_S1123C) WhcAg construct
  source 1..4123: mol_type = other RNA
aggagaaagcttaccatgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagtgcgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtgtggcaactgcgacgttgtgatcggcattgtgaacaataccgtgtacgaccctctgcagcccgagctggacagcggaggcggaggatctgacatcgacccctacaaagagttcggcagcagctaccagctgctgaacttcctgcctctggacttcttccccgacctgaacgccctggtggatacagccacagctctgtacgaggaagaactgaccggcagagagcactgcagccctcaccacacagccattagacaggccctcgtgtgctgggacgagctgacaaaactgatcgcctggatgagcagcaacatcaccagcgagcaagtgcggaccatcatcgtgaaccacgtgaacgatacctggggcctgaaagtgcggcagagcctgtggtttcacctgagctgtctgaccttcggccagcacaccgtgcaagagtttctggtgtccttcggcgtgtggatcagaacccctgctccatacagacctccaaacgctcccatcctgagcaccctgcctgagcacacagtgatctgttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 14178-22728 - skipped (8551 entries)

SEQ ID NO: 22729 - DNA, 23 bp, synthetic construct
  misc_feature 1..23: note = Primer 2019-nCoV_sgE-forward
  source 1..23: mol_type = other DNA
cgatctcttgtagatctgttctc

SEQ ID NO: 22730 - DNA, 22 bp, synthetic construct
  misc_feature 1..22: note = Primer 2019-nCoV_sgE-reverse
  source 1..22: mol_type = other DNA
atattgcagcagtacgcacaca

SEQ ID NO: 22731 - DNA, 26 bp, synthetic construct
  misc_feature 1..26: note = Primer 2019-nCoV_sgE-probe
  source 1..26: mol_type = other DNA
acactagccatccttactgcgcttcg

SEQ ID NO: 22732 - protein, 1273 aa, synthetic construct
  REGION 1..1273: note = SARS-CoV-2/Wuhan/WIV05/2019__EPI_ISL_402128 spike protein (1-1273)(K986P_V987P_F817P_A892P_A899P_A942P)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSPIEDLLFNKVTLADAGFIKQYGDCLGDIAARDLICAQKFNGLTVLPPLLTDEMIAQYTSALLAGTITSGWTFGAGPALQIPFPMQMAYRFNGIGVTQNVLYENQKLIANQFNSAIGKIQDSLSSTPSALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22733 - protein, 383 aa, synthetic construct
  REGION 1..383: note = SARS-CoV-2/Wuhan/WIV05/2019__EPI_ISL_402128 spike protein (1-15,334-528) Ferritin construct
MFVFLVLLPLVSSQCNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKGGGGSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 22734 - protein, 249 aa, synthetic construct
  REGION 1..249: note = SARS-CoV-2/Wuhan/WIV05/2019__EPI_ISL_402128 spike protein (334-528) Foldon construct
MPMGSLQPLATLYLLGMLVASVLANLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKGSGGYIPEAPRDGQAYVRKDGEWVLLSTFL

SEQ ID NO: 22735 - protein, 375 aa, synthetic construct
  REGION 1..375: note = SARS-CoV-2/Wuhan/WIV05/2019__EPI_ISL_402128 spike protein (1-15,334-528) LumSynth construct
MFVFLVLLPLVSSQCNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKGGGGSGGGGSGGQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 22736 - protein, 362 aa, synthetic construct
  REGION 1..362: note = SARS-CoV-2/Wuhan/WIV05/2019__EPI_ISL_402128 spike protein (334-528) LumSynth construct
MQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLRGGGGSGGGGSGGGNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPK

SEQ ID NO: 22737 - protein, 1273 aa, synthetic construct; identical to SEQ ID NO: 9
  REGION 1..1273: note = SARS-CoV-2/Wuhan/WIV05/2019__EPI_ISL_402128 spike protein (1-1273)(D614G)

SEQ ID NO: 22738 - protein, 1273 aa, synthetic construct; identical to SEQ ID NO: 18
  REGION 1..1273: note = SARS-CoV-2/Wuhan/WIV05/2019__EPI_ISL_402128 spike protein (1-1273)(K986P_V987P_ D614G)

SEQ ID NO: 22739 - protein, 1273 aa, synthetic construct
  REGION 1..1273: note = SARS-CoV-2/Wuhan/WIV05/2019__EPI_ISL_402128 spike protein (1-1273)(A222V_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22740 - protein, 1273 aa, synthetic construct
  REGION 1..1273: note = SARS-CoV-2/Wuhan/WIV05/2019__EPI_ISL_402128 spike protein (1-1273)(K986P_V987P_A222V_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22741 - protein, 1273 aa, synthetic construct
  REGION 1..1273: note = SARS-CoV-2/Wuhan/WIV05/2019__EPI_ISL_402128 spike protein (1-1273)(N439K_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSKNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22742 - protein, 1273 aa, synthetic construct
  REGION 1..1273: note = SARS-CoV-2/Wuhan/WIV05/2019__EPI_ISL_402128 spike protein (1-1273)(K986P_V987P_N439K_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSKNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22743 - protein, 1273 aa, synthetic construct
  REGION 1..1273: note = SARS-CoV-2/Wuhan/WIV05/2019__EPI_ISL_402128 spike protein (1-1273)(S477N_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22744 - protein, 1273 aa, synthetic construct
  REGION 1..1273: note = SARS-CoV-2/Wuhan/WIV05/2019__EPI_ISL_402128 spike protein (1-1273)(K986P_V987P_S477N_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22745 - protein, 1273 aa, synthetic construct
  REGION 1..1273: note = SARS-CoV-2/Wuhan/WIV05/2019__EPI_ISL_402128 spike protein (1-1273)(N501Y_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22746 - protein, 1273 aa, synthetic construct
  REGION 1..1273: note = SARS-CoV-2/Wuhan/WIV05/2019__EPI_ISL_402128 spike protein (1-1273)(K986P_V987P_N501Y_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22747 - protein, 1271 aa, synthetic construct
  REGION 1..1271: note = SARS-CoV-2/Wuhan/WIV05/2019__EPI_ISL_402128 spike protein (1-1273)(H69del_V70del_D614G)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22748 - protein, 1271 aa, synthetic construct
  REGION 1..1271: note = SARS-CoV-2/Wuhan/WIV05/2019__EPI_ISL_402128 spike protein (1-1273)(K986P_V987P_H69del_V70del_D614G)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22749 - protein, 1273 aa, synthetic construct
  REGION 1..1273: note = SARS-CoV-2/Wuhan/WIV05/2019__EPI_ISL_402128 spike protein (1-1273)(Y453F_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22750 - protein, 1273 aa, synthetic construct
  REGION 1..1273: note = SARS-CoV-2/Wuhan/WIV05/2019__EPI_ISL_402128 spike protein (1-1273)(K986P_V987P_Y453F_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22751 - protein, 1273 aa, synthetic construct
  REGION 1..1273: note = SARS-CoV-2/Wuhan/WIV05/2019__EPI_ISL_402128 spike protein (1-1273)(D614G_I692V)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSVIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22752 - protein, 1273 aa, synthetic construct
  REGION 1..1273: note = SARS-CoV-2/Wuhan/WIV05/2019__EPI_ISL_402128 spike protein (1-1273)(K986P_V987P_D614G_I692V)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSVIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22753 - protein, 1273 aa, synthetic construct; identical to SEQ ID NO: 327
  REGION 1..1273: note = SARS-CoV-2/Wuhan/WIV05/2019__EPI_ISL_402128 spike protein (1-1273)(D614G_M1229I)

SEQ ID NO: 22754 - protein, 1273 aa, synthetic construct; identical to SEQ ID NO: 394
  REGION 1..1273: note = SARS-CoV-2/Wuhan/WIV05/2019__EPI_ISL_402128 spike protein (1-1273)(K986P_V987P_D614G_M1229I)

SEQ ID NO: 22755 - protein, 1271 aa, synthetic construct
  REGION 1..1271: note = SARS-CoV-2/Wuhan/WIV05/2019__EPI_ISL_402128 spike protein (1-1273)(H69del_V70del_A222V_Y453F_S477N_D614G_I692V)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGNTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSVIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22756 - protein, 1271 aa, synthetic construct
  REGION 1..1271: note = SARS-CoV-2/Wuhan/WIV05/2019__EPI_ISL_402128 spike protein (1-1273)(K986P_V987P_H69del_V70del_A222V_Y453F_S477N_D614G_ I692V)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSVLEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGNTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSVIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22757 - protein, 1271 aa, synthetic construct
  REGION 1..1271: note = SARS-CoV-2/Wuhan/WIV05/2019__EPI_ISL_402128 spike protein (1-1273)(H69del_V70del_Y453F_D614G_I692V_M1229I)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSVIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 22758 - protein, 1271 aa, synthetic construct
  REGION 1..1271: note = SARS-CoV-2/Wuhan/WIV05/2019__EPI_ISL_402128 spike protein (1-1273)(K986P_V987P_H69del_V70del_Y453F_D614G_I692V_M1229I )
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLFRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSVIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVIVTIMLCCMTSCCSCLKGCCSCGSCCKFDEDDSEPVLKGVKLHYT

SEQ ID NO: 22759 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_F817P_A892P_A899P_A942P)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtcccccatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggccccgccctgcagatccccttcccgatgcagatggcctaccggttcaacggcatcggggtcacccagaacgtgctctacgagaaccagaagctgatcgccaaccagttcaacagcgccatcggcaagatccaggactccctgagctccacccccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22760 - RNA, 1152 nt, synthetic construct
  misc_feature 1..1152: note = SARS-CoV-2/Wuhan/WIV05/2019__EPI_ISL_402128 spike protein CDS gc (1-15,334-528) Ferritin construct
  source 1..1152: mol_type = other RNA
atgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 22761 - RNA, 750 nt, synthetic construct
  misc_feature 1..750: note = SARS-CoV-2/Wuhan/WIV05/2019__EPI_ISL_402128 spike protein CDS gc (334-528) Foldon construct
  source 1..750: mol_type = other RNA
atgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctga

SEQ ID NO: 22762 - RNA, 1128 nt, synthetic construct
  misc_feature 1..1128: note = SARS-CoV-2/Wuhan/WIV05/2019__EPI_ISL_402128 spike protein CDS gc (1-15,334-528) LumSynth construct
  source 1..1128: mol_type = other RNA
atgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctga

SEQ ID NO: 22763 - RNA, 1089 nt, synthetic construct
  misc_feature 1..1089: note = SARS-CoV-2/Wuhan/WIV05/2019__EPI_ISL_402128 spike protein CDS gc (334-528) LumSynth construct
  source 1..1089: mol_type = other RNA
atgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtga

SEQ ID NO: 22764 - RNA, 3822 nt, synthetic construct
  misc_feature 1..3822: note = SARS-CoV-2/Wuhan/WIV05/2019__EPI_ISL_402128 spike protein CDS gc (1-1273)(D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22765 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_ D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22766 - RNA, 3822 nt, synthetic construct
  misc_feature 1..3822: note = SARS-CoV-2/Wuhan/WIV05/2019__EPI_ISL_402128 spike protein CDS gc (1-1273)(A222V_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22767 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_A222V_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22768 - RNA, 3822 nt, synthetic construct
  misc_feature 1..3822: note = SARS-CoV-2/Wuhan/WIV05/2019__EPI_ISL_402128 spike protein CDS gc (1-1273)(N439K_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22769 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_N439K_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22770 - RNA, 3822 nt, synthetic construct
  misc_feature 1..3822: note = SARS-CoV-2/Wuhan/WIV05/2019__EPI_ISL_402128 spike protein CDS gc (1-1273)(S477N_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22771 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_S477N_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22772 - RNA, 3822 nt, synthetic construct
  misc_feature 1..3822: note = SARS-CoV-2/Wuhan/WIV05/2019__EPI_ISL_402128 spike protein CDS gc (1-1273)(N501Y_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22773 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_N501Y_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22774 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_D614G)
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22775 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_D614G)
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22776 - RNA, 3822 nt, synthetic construct
  misc_feature 1..3822: note = SARS-CoV-2/Wuhan/WIV05/2019__EPI_ISL_402128 spike protein CDS gc (1-1273)(Y453F_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22777 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_Y453F_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22778 - RNA, 3822 nt, synthetic construct
  misc_feature 1..3822: note = SARS-CoV-2/Wuhan/WIV05/2019__EPI_ISL_402128 spike protein CDS gc (1-1273)(D614G_I692V)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22779 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_D614G_I692V)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22780 - RNA, 3822 nt, synthetic construct
  misc_feature 1..3822: note = SARS-CoV-2/Wuhan/WIV05/2019__EPI_ISL_402128 spike protein CDS gc (1-1273)(D614G_M1229I)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22781 - RNA, 3822 nt, synthetic construct
  misc_feature 1..3822: note = SARS-CoV-2/Wuhan/WIV05/2019__EPI_ISL_402128 spike protein CDS gc (1-1273)(K986P_V987P_D614G_M1229I)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22782 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_A222V_Y453F_S477N_D614G_I692V)
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22783 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_A222V_Y453F_S477N_D614G_ I692V)
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22784 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_Y453F_D614G_I692V_M1229I)
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22785 - RNA, 3816 nt, synthetic construct
  misc_feature 1..3816: note = SARS-CoV-2/Wuhan/WIV05/2019__EPI_ISL_402128 spike protein CDS gc (1-1273)(K986P_V987P_H69del_V70del_Y453F_D614G_I692V_M1229I )
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22786 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_F817P_A892P_A899P_A942P)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtcccccatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggccccgccctgcagatccccttcccgatgcagatggcctaccggttcaacggcatcggggtcacccagaacgtgctctacgagaaccagaagctgatcgccaaccagttcaacagcgccatcggcaagatccaggactccctgagctccacccccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22787 - RNA, 1424 nt, synthetic construct
  misc_feature 1..1424: note = SARS-CoV-2/Wuhan/WIV05/2019__EPI_ISL_402128 spike protein mRNA gc (1-15,334-528) Ferritin construct R10340
  source 1..1424: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22788 - RNA, 1022 nt, synthetic construct
  misc_feature 1..1022: note = SARS-CoV-2/Wuhan/WIV05/2019__EPI_ISL_402128 spike protein mRNA gc (334-528) Foldon construct R9927
  source 1..1022: mol_type = other RNA
aggagagtcccgcagtcggcgtccagcggctctgcttgttcgtgtgtgtgtcgttgcaggccttattcaagcttaccatgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22789 - RNA, 1400 nt, synthetic construct
  misc_feature 1..1400: note = SARS-CoV-2/Wuhan/WIV05/2019__EPI_ISL_402128 spike protein mRNA gc (1-15,334-528) LumSynth construct R10338
  source 1..1400: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22790 - RNA, 1361 nt, synthetic construct
  misc_feature 1..1361: note = SARS-CoV-2/Wuhan/WIV05/2019__EPI_ISL_402128 spike protein mRNA gc (334-528) LumSynth construct R10339
  source 1..1361: mol_type = other RNA
aggagagtcccgcagtcggcgtccagcggctctgcttgttcgtgtgtgtgtcgttgcaggccttattcaagcttaccatgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22791 - RNA, 4094 nt, synthetic construct
  misc_feature 1..4094: note = SARS-CoV-2/Wuhan/WIV05/2019__EPI_ISL_402128 spike protein mRNA gc (1-1273)(D614G) R10182
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22792 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_ D614G) R10166
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22793 - RNA, 4094 nt, synthetic construct
  misc_feature 1..4094: note = SARS-CoV-2/Wuhan/WIV05/2019__EPI_ISL_402128 spike protein mRNA gc (1-1273)(A222V_D614G) R10278
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22794 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_A222V_D614G) R10279
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22795 - RNA, 4094 nt, synthetic construct
  misc_feature 1..4094: note = SARS-CoV-2/Wuhan/WIV05/2019__EPI_ISL_402128 spike protein mRNA gc (1-1273)(N439K_D614G) R10298
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22796 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_N439K_D614G) R10299
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22797 - RNA, 4094 nt, synthetic construct
  misc_feature 1..4094: note = SARS-CoV-2/Wuhan/WIV05/2019__EPI_ISL_402128 spike protein mRNA gc (1-1273)(S477N_D614G) R10287
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22798 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_S477N_D614G) R10286
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22799 - RNA, 4094 nt, synthetic construct
  misc_feature 1..4094: note = SARS-CoV-2/Wuhan/WIV05/2019__EPI_ISL_402128 spike protein mRNA gc (1-1273)(N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22800 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_N501Y_D614G)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22801 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_D614G) R10274
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22802 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_D614G) R10275
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22803 - RNA, 4094 nt, synthetic construct
  misc_feature 1..4094: note = SARS-CoV-2/Wuhan/WIV05/2019__EPI_ISL_402128 spike protein mRNA gc (1-1273)(Y453F_D614G) R10282
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22804 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_Y453F_D614G) R10283
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22805 - RNA, 4094 nt, synthetic construct
  misc_feature 1..4094: note = SARS-CoV-2/Wuhan/WIV05/2019__EPI_ISL_402128 spike protein mRNA gc (1-1273)(D614G_I692V) R10290
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22806 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_D614G_I692V) R10291
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22807 - RNA, 4094 nt, synthetic construct
  misc_feature 1..4094: note = SARS-CoV-2/Wuhan/WIV05/2019__EPI_ISL_402128 spike protein mRNA gc (1-1273)(D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22808 - RNA, 4094 nt, synthetic construct
  misc_feature 1..4094: note = SARS-CoV-2/Wuhan/WIV05/2019__EPI_ISL_402128 spike protein mRNA gc (1-1273)(K986P_V987P_D614G_M1229I)
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22809 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_A222V_Y453F_S477N_D614G_I692V) R10294
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22810 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)R10295
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22811 - RNA, 4088 nt, synthetic construct
  misc_feature 1..4088: note = SARS-CoV-2/Wuhan/WIV05/2019__EPI_ISL_402128 spike protein mRNA gc (1-1273)(H69del_V70del_Y453F_D614G_I692V_M1229I)
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22812 - RNA, 4088 nt, synthetic construct
  misc_feature 1..4088: note = SARS-CoV-2/Wuhan/WIV05/2019__EPI_ISL_402128 spike protein mRNA gc (1-1273)(K986P_V987P_H69del_V70del_Y453F_D614G_I692V_M1229I )
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 22813 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_F817P_A892P_A899P_A942P) R9848
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtcccccatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggccccgccctgcagatccccttcccgatgcagatggcctaccggttcaacggcatcggggtcacccagaacgtgctctacgagaaccagaagctgatcgccaaccagttcaacagcgccatcggcaagatccaggactccctgagctccacccccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22814 - RNA, 1369 nt, synthetic construct
  misc_feature 1..1369: note = SARS-CoV-2/Wuhan/WIV05/2019__EPI_ISL_402128 spike protein mRNA gc (1-15,334-528) Ferritin construct R10337
  source 1..1369: mol_type = other RNA
aggagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcgggggtggaagcggcgggggtggaagtgacatcatcaagctcctgaacgagcaggtcaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtgcccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22815 - RNA, 967 nt, synthetic construct
  misc_feature 1..967: note = SARS-CoV-2/Wuhan/WIV05/2019__EPI_ISL_402128 spike protein mRNA gc (334-528) Foldon construct R9926
  source 1..967: mol_type = other RNA
aggagaaagcttaccatgcccatgggcagcctgcagccgctcgccaccctgtacctgctcgggatgctggtggcctccgtcctggcgaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcagcggcgggtacatccccgaggccccgcgcgacggccaggcctacgtgcggaaggacggcgagtgggtcctgctgagcaccttcctctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22816 - RNA, 1345 nt, synthetic construct
  misc_feature 1..1345: note = SARS-CoV-2/Wuhan/WIV05/2019__EPI_ISL_402128 spike protein mRNA gc (1-15,334-528) LumSynth construct R10335
  source 1..1345: mol_type = other RNA
aggagaaagcttaccatgttcgtgttcctggtcctcctgcccctggtgagctcccagtgcaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagggcggcggcggctccggaggcggaggtagcgggggacagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22817 - RNA, 1306 nt, synthetic construct
  misc_feature 1..1306: note = SARS-CoV-2/Wuhan/WIV05/2019__EPI_ISL_402128 spike protein mRNA gc (334-528) LumSynth construct R10336
  source 1..1306: mol_type = other RNA
aggagaaagcttaccatgcagatctacgagggcaagctgaccgccgaggggctccgcttcggcatcgtggccagccggttcaaccacgcgctggtcgaccgcctggtggagggggccatcgacgccatcgtgcggcacggcgggcgcgaggaggacatcaccctcgtccgggtgcccggctcctgggagatcccggtggccgccggcgagctggcccgcaaggaggacatcgacgcggtcatcgccatcggggtgctgatccggggcgccacgccccacttcgactacatcgccagcgaggtgtccaaggggctcgcggacctgagcctggagctccgcaagcccatcaccttcggcgtcatcaccgccgacaccctggagcaggccatcgagcgggccgggacgaagcacggcaacaagggctgggaggccgcgctgtccgccatcgagatggccaacctcttcaagagcctgcgcggcgggggcgggagcggcgggggcggctccgggggcgggaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22818 - RNA, 4039 nt, synthetic construct
  misc_feature 1..4039: note = SARS-CoV-2/Wuhan/WIV05/2019__EPI_ISL_402128 spike protein mRNA gc (1-1273)(D614G)
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22819 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_ D614G) R10165
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22820 - RNA, 4039 nt, synthetic construct
  misc_feature 1..4039: note = SARS-CoV-2/Wuhan/WIV05/2019__EPI_ISL_402128 spike protein mRNA gc (1-1273)(A222V_D614G) R10276
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22821 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_A222V_D614G) R10277
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22822 - RNA, 4039 nt, synthetic construct
  misc_feature 1..4039: note = SARS-CoV-2/Wuhan/WIV05/2019__EPI_ISL_402128 spike protein mRNA gc (1-1273)(N439K_D614G) R10296
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22823 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_N439K_D614G) R10297
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22824 - RNA, 4039 nt, synthetic construct
  misc_feature 1..4039: note = SARS-CoV-2/Wuhan/WIV05/2019__EPI_ISL_402128 spike protein mRNA gc (1-1273)(S477N_D614G) R10284
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22825 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_S477N_D614G) R10285
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22826 - RNA, 4039 nt, synthetic construct
  misc_feature 1..4039: note = SARS-CoV-2/Wuhan/WIV05/2019__EPI_ISL_402128 spike protein mRNA gc (1-1273)(N501Y_D614G) R10350
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22827 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_N501Y_D614G) R10351
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22828 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_D614G) R10272
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22829 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_D614G) R10273
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22830 - RNA, 4039 nt, synthetic construct
  misc_feature 1..4039: note = SARS-CoV-2/Wuhan/WIV05/2019__EPI_ISL_402128 spike protein mRNA gc (1-1273)(Y453F_D614G) R10280
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22831 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_Y453F_D614G) R10281
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22832 - RNA, 4039 nt, synthetic construct
  misc_feature 1..4039: note = SARS-CoV-2/Wuhan/WIV05/2019__EPI_ISL_402128 spike protein mRNA gc (1-1273)(D614G_I692V) R10288
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22833 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_D614G_I692V) R10289
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22834 - RNA, 4039 nt, synthetic construct
  misc_feature 1..4039: note = SARS-CoV-2/Wuhan/WIV05/2019__EPI_ISL_402128 spike protein mRNA gc (1-1273)(D614G_M1229I) R10344
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22835 - RNA, 4039 nt, synthetic construct
  misc_feature 1..4039: note = SARS-CoV-2/Wuhan/WIV05/2019__EPI_ISL_402128 spike protein mRNA gc (1-1273)(K986P_V987P_D614G_M1229I) R10345
  source 1..4039: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22836 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_A222V_Y453F_S477N_D614G_I692V) R10292
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22837 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_A222V_Y453F_S477N_D614G_ I692V)R10293
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtcctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcaacaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22838 - RNA, 4033 nt, synthetic construct
  misc_feature 1..4033: note = SARS-CoV-2/Wuhan/WIV05/2019__EPI_ISL_402128 spike protein mRNA gc (1-1273)(H69del_V70del_Y453F_D614G_I692V_M1229I) R10346
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22839 - RNA, 4033 nt, synthetic construct
  misc_feature 1..4033: note = SARS-CoV-2/Wuhan/WIV05/2019__EPI_ISL_402128 spike protein mRNA gc (1-1273)(K986P_V987P_H69del_V70del_Y453F_D614G_I692V_M1229I )R10347
  source 1..4033: mol_type = other RNA
aggagaaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcgtgatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatcgtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22840-22847 - skipped (8 entries)

SEQ ID NO: 22848 - DNA, 57 bp, synthetic construct
  misc_feature 1..57: note = synthetic-v1 5'-UTR
  source 1..57: mol_type = other DNA
gggaaataagagagaaaagaagagtaagaagaaatataagaccccggcgccgccacc

SEQ ID NO: 22849 - RNA, 57 nt, synthetic construct
  misc_feature 1..57: note = synthetic-v1 5'-UTR
  source 1..57: mol_type = other RNA
gggaaataagagagaaaagaagagtaagaagaaatataagaccccggcgccgccacc

SEQ ID NO: 22850 - DNA, 57 bp, synthetic construct
  misc_feature 1..57: note = synthetic-v2 5'-UTR
  source 1..57: mol_type = other DNA
aggagataagagagaaaagaagagtaagaagaaatataagaccccggcgccgccacc

SEQ ID NO: 22851 - RNA, 57 nt, synthetic construct
  misc_feature 1..57: note = synthetic-v2 5'-UTR
  source 1..57: mol_type = other RNA
aggagataagagagaaaagaagagtaagaagaaatataagaccccggcgccgccacc

SEQ ID NO: 22852 - DNA, 47 bp, synthetic construct
  misc_feature 1..47: note = synthetic-v3 5'-UTR
  source 1..47: mol_type = other DNA
gggaaataagagagaaaagaagagtaagaagaaatataagagccacc

SEQ ID NO: 22853 - RNA, 47 nt, synthetic construct
  misc_feature 1..47: note = synthetic-v3 5'-UTR
  source 1..47: mol_type = other RNA
gggaaataagagagaaaagaagagtaagaagaaatataagagccacc

SEQ ID NO: 22854 - DNA, 47 bp, synthetic construct
  misc_feature 1..47: note = synthetic-v4 5'-UTR
  source 1..47: mol_type = other DNA
aggagataagagagaaaagaagagtaagaagaaatataagagccacc

SEQ ID NO: 22855 - RNA, 47 nt, synthetic construct
  misc_feature 1..47: note = synthetic-v4 5'-UTR
  source 1..47: mol_type = other RNA
aggagataagagagaaaagaagagtaagaagaaatataagagccacc

SEQ ID NO: 22856 - DNA, 53 bp, synthetic construct
  misc_feature 1..53: note = HBA1-v1 5'-UTR
  source 1..53: mol_type = other DNA
agaataaactagtattcttctggtccccacagactcagagagaacccgccacc

SEQ ID NO: 22857 - RNA, 53 nt, synthetic construct
  misc_feature 1..53: note = HBA1-v1 5'-UTR
  source 1..53: mol_type = other RNA
agaataaactagtattcttctggtccccacagactcagagagaacccgccacc

SEQ ID NO: 22858 - DNA, 56 bp, synthetic construct
  misc_feature 1..56: note = HBA1-v2 5'-UTR
  source 1..56: mol_type = other DNA
aggagaataaactagtattcttctggtccccacagactcagagagaacccgccacc

SEQ ID NO: 22859 - RNA, 56 nt, synthetic construct
  misc_feature 1..56: note = HBA1-v2 5'-UTR
  source 1..56: mol_type = other RNA
aggagaataaactagtattcttctggtccccacagactcagagagaacccgccacc

SEQ ID NO: 22860 - DNA, 53 bp, synthetic construct
  misc_feature 1..53: note = HBA1-v3 5'-UTR
  source 1..53: mol_type = other DNA
aggagaaactagtattcttctggtccccacagactcagagagaacccgccacc

SEQ ID NO: 22861 - RNA, 53 nt, synthetic construct
  misc_feature 1..53: note = HBA1-v3 5'-UTR
  source 1..53: mol_type = other RNA
aggagaaactagtattcttctggtccccacagactcagagagaacccgccacc

SEQ ID NO: 22862 - DNA, 53 bp, synthetic construct
  misc_feature 1..53: note = HBA1-v4 5'-UTR
  source 1..53: mol_type = other DNA
agattaaactagtattcttctggtccccacagactcagagagaacccgccacc

SEQ ID NO: 22863 - RNA, 53 nt, synthetic construct
  misc_feature 1..53: note = HBA1-v4 5'-UTR
  source 1..53: mol_type = other RNA
agattaaactagtattcttctggtccccacagactcagagagaacccgccacc

SEQ ID NO: 22864 - DNA, 52 bp, synthetic construct
  misc_feature 1..52: note = HBA1-v5 5'-UTR
  source 1..52: mol_type = other DNA
agacgaactagtattcttctggtccccacagactcagagagaacccgccacc

SEQ ID NO: 22865 - RNA, 52 nt, synthetic construct
  misc_feature 1..52: note = HBA1-v5 5'-UTR
  source 1..52: mol_type = other RNA
agacgaactagtattcttctggtccccacagactcagagagaacccgccacc

SEQ ID NO: 22866 - DNA, 52 bp, synthetic construct
  misc_feature 1..52: note = HBA1-v6 5'-UTR
  source 1..52: mol_type = other DNA
gggcgaactagtattcttctggtccccacagactcagagagaacccgccacc

SEQ ID NO: 22867 - RNA, 52 nt, synthetic construct
  misc_feature 1..52: note = HBA1-v6 5'-UTR
  source 1..52: mol_type = other RNA
gggcgaactagtattcttctggtccccacagactcagagagaacccgccacc

SEQ ID NO: 22868 - DNA, 15 bp, synthetic construct
  misc_feature 1..15: note = minimal 5'-UTR
  source 1..15: mol_type = other DNA
aggagaaagcttacc

SEQ ID NO: 22869 - RNA, 15 nt, synthetic construct
  misc_feature 1..15: note = minimal 5'-UTR
  source 1..15: mol_type = other RNA
aggagaaagcttacc

SEQ ID NO: 22870 - DNA, 77 bp, synthetic construct
  misc_feature 1..77: note = HSD17B4-v2 5'-UTR
  source 1..77: mol_type = other DNA
aggagagtcccgcagtcggcgtccagcggctctgcttgttcgtgtgtgtgtcgttgcaggccttattcaagcttacc

SEQ ID NO: 22871 - RNA, 77 nt, synthetic construct
  misc_feature 1..77: note = HSD17B4-v2 5'-UTR
  source 1..77: mol_type = other RNA
aggagagtcccgcagtcggcgtccagcggctctgcttgttcgtgtgtgtgtcgttgcaggccttattcaagcttacc

SEQ ID NO: 22872 - DNA, 99 bp, synthetic construct
  misc_feature 1..99: note = Rpl31-v2 5'-UTR
  source 1..99: mol_type = other DNA
aggagacccgtgacccggaagttgtacggctacgcgactttccctcccacaaaccctcgcgcccttcctttcctacttgggcccggcagaaagcttacc

SEQ ID NO: 22873 - RNA, 99 nt, synthetic construct
  misc_feature 1..99: note = Rpl31-v2 5'-UTR
  source 1..99: mol_type = other RNA
aggagacccgtgacccggaagttgtacggctacgcgactttccctcccacaaaccctcgcgcccttcctttcctacttgggcccggcagaaagcttacc

SEQ ID NO: 22874 - DNA, 174 bp, synthetic construct
  misc_feature 1..174: note = Slc7a3-v2 5'-UTR
  source 1..174: mol_type = other DNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttacc

SEQ ID NO: 22875 - RNA, 174 nt, synthetic construct
  misc_feature 1..174: note = Slc7a3-v2 5'-UTR
  source 1..174: mol_type = other RNA
aggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttacc

SEQ ID NO: 22876 - DNA, 110 bp, synthetic construct
  misc_feature 1..110: note = HBA1-v1 3'-UTR
  source 1..110: mol_type = other DNA
gctggagcctcggtggccatgcttcttgccccttgggcctccccccagcccctcctccccttcctgcacccgtacccccgtggtctttgaataaagtctgagtgggcggc

SEQ ID NO: 22877 - RNA, 110 nt, synthetic construct
  misc_feature 1..110: note = HBA1-v1 3'-UTR
  source 1..110: mol_type = other RNA
gctggagcctcggtggccatgcttcttgccccttgggcctccccccagcccctcctccccttcctgcacccgtacccccgtggtctttgaataaagtctgagtgggcggc

SEQ ID NO: 22878 - DNA, 108 bp, synthetic construct
  misc_feature 1..108: note = HBA2 3'-UTR
  source 1..108: mol_type = other DNA
gctggagcctcggtagccgttcctcctgcccgctgggcctcccaacgggccctcctcccctccttgcaccggcccttcctggtctttgaataaagtctgagtgggcag

SEQ ID NO: 22879 - RNA, 108 nt, synthetic construct
  misc_feature 1..108: note = HBA2 3'-UTR
  source 1..108: mol_type = other RNA
gctggagcctcggtagccgttcctcctgcccgctgggcctcccaacgggccctcctcccctccttgcaccggcccttcctggtctttgaataaagtctgagtgggcag

SEQ ID NO: 22880 - DNA, 132 bp, synthetic construct
  misc_feature 1..132: note = HBB-v1 3'-UTR
  source 1..132: mol_type = other DNA
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 22881 - RNA, 132 nt, synthetic construct
  misc_feature 1..132: note = HBB-v1 3'-UTR
  source 1..132: mol_type = other RNA
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 22882 - DNA, 119 bp, synthetic construct
  misc_feature 1..119: note = HBA1-v2 3'-UTR
  source 1..119: mol_type = other DNA
tgataataggctggagcctcggtggcctagcttcttgccccttgggcctccccccagcccctcctccccttcctgcacccgtacccccgtggtctttgaataaagtctgagtgggcggc

SEQ ID NO: 22883 - RNA, 119 nt, synthetic construct
  misc_feature 1..119: note = HBA1-v2 3'-UTR
  source 1..119: mol_type = other RNA
tgataataggctggagcctcggtggcctagcttcttgccccttgggcctccccccagcccctcctccccttcctgcacccgtacccccgtggtctttgaataaagtctgagtgggcggc

SEQ ID NO: 22884 - DNA, 119 bp, synthetic construct
  misc_feature 1..119: note = HBA1-v3 3'-UTR
  source 1..119: mol_type = other DNA
tgataataggctggagcctcggtggccatgcttcttgccccttgggcctccccccagcccctcctccccttcctgcacccgtacccccgtggtctttgaataaagtctgagtgggcggc

SEQ ID NO: 22885 - RNA, 119 nt, synthetic construct
  misc_feature 1..119: note = HBA1-v33'-UTR
  source 1..119: mol_type = other RNA
tgataataggctggagcctcggtggccatgcttcttgccccttgggcctccccccagcccctcctccccttcctgcacccgtacccccgtggtctttgaataaagtctgagtgggcggc

SEQ ID NO: 22886 - DNA, 295 bp, synthetic construct
  misc_feature 1..295: note = AES-12S-v1 3'-UTR
  source 1..295: mol_type = other DNA
ctcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccctggagctagc

SEQ ID NO: 22887 - RNA, 295 nt, synthetic construct
  misc_feature 1..295: note = AES-12S-v1 3'-UTR
  source 1..295: mol_type = other RNA
ctcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccctggagctagc

SEQ ID NO: 22888 - DNA, 317 bp, synthetic construct
  misc_feature 1..317: note = AES-12S-v2 3'-UTR
  source 1..317: mol_type = other DNA
ctcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccgagacctggtccagagtcgctagccgcgtcgct

SEQ ID NO: 22889 - RNA, 317 nt, synthetic construct
  misc_feature 1..317: note = AES-12S-v2 3'-UTR
  source 1..317: mol_type = other RNA
ctcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccgagacctggtccagagtcgctagccgcgtcgct

SEQ ID NO: 22890 - DNA, 311 bp, synthetic construct
  misc_feature 1..311: note = HBB-v2 3'-UTR
  source 1..311: mol_type = other DNA
ctcgagagctcgctttcttgctgtccaatttctattaaaggttcctttgttccctaagtccaactactaaactgggggatattatgaagggccttgagcatctggattctgcctaataaaaaacatttattttcattgctgcgtcgagagctcgctttcttgctgtccaatttctattaaaggttcctttgttccctaagtccaactactaaactgggggatattatgaagggccttgagcatctggattctgcctaataaaaaacatttattttcattgctgcgtcgagacctggtccagagtcgctagc

SEQ ID NO: 22891 - RNA, 311 nt, synthetic construct
  misc_feature 1..311: note = HBB-v2 3'-UTR
  source 1..311: mol_type = other RNA
ctcgagagctcgctttcttgctgtccaatttctattaaaggttcctttgttccctaagtccaactactaaactgggggatattatgaagggccttgagcatctggattctgcctaataaaaaacatttattttcattgctgcgtcgagagctcgctttcttgctgtccaatttctattaaaggttcctttgttccctaagtccaactactaaactgggggatattatgaagggccttgagcatctggattctgcctaataaaaaacatttattttcattgctgcgtcgagacctggtccagagtcgctagc

SEQ ID NO: 22892 - DNA, 95 bp, synthetic construct
  misc_feature 1..95: note = PSMB3-v2 3'-UTR
  source 1..95: mol_type = other DNA
ggactagtccctgttcccagagcccacttttttttctttttttgaaataaaatagcctgtctttcagatctcaaaggctcttttcagagccacca

SEQ ID NO: 22893 - RNA, 95 nt, synthetic construct
  misc_feature 1..95: note = PSMB3-v2 3'-UTR
  source 1..95: mol_type = other RNA
ggactagtccctgttcccagagcccacttttttttctttttttgaaataaaatagcctgtctttcagatctcaaaggctcttttcagagccacca

SEQ ID NO: 22894 - DNA, 108 bp, synthetic construct
  misc_feature 1..108: note = RPS9-v2 3'-UTR
  source 1..108: mol_type = other DNA
ggactagtgtccacctgtccctcctgggctgctggattgtctcgttttcctgccaaataaacaggatcagcgctttacagatctcaaaggctcttttcagagccacca

SEQ ID NO: 22895 - RNA, 108 nt, synthetic construct
  misc_feature 1..108: note = RPS9-v2 3'-UTR
  source 1..108: mol_type = other RNA
ggactagtgtccacctgtccctcctgggctgctggattgtctcgttttcctgccaaataaacaggatcagcgctttacagatctcaaaggctcttttcagagccacca

SEQ ID NO: 22896 - DNA, 98 bp, synthetic construct
  misc_feature 1..98: note = muag-v2 3'-UTR
  source 1..98: mol_type = other DNA
ggactagttataagactgactagcccgatgggcctcccaacgggccctcctcccctccttgcaccgagattaatcaaaggctcttttcagagccacca

SEQ ID NO: 22897 - RNA, 98 nt, synthetic construct
  misc_feature 1..98: note = muag-v2 3'-UTR
  source 1..98: mol_type = other RNA
ggactagttataagactgactagcccgatgggcctcccaacgggccctcctcccctccttgcaccgagattaatcaaaggctcttttcagagccacca

SEQ ID NO: 22898 - DNA, 104 bp, synthetic construct
  misc_feature 1..104: note = muag-v2 3'-UTR
  source 1..104: mol_type = other DNA
ggactagttataagactgactagcccgatgggcctcccaacgggccctcctcccctccttgcaccgagattaatagatctcaaaggctcttttcagagccacca

SEQ ID NO: 22899 - RNA, 104 nt, synthetic construct
  misc_feature 1..104: note = muag-v2 3'-UTR
  source 1..104: mol_type = other RNA
ggactagttataagactgactagcccgatgggcctcccaacgggccctcctcccctccttgcaccgagattaatagatctcaaaggctcttttcagagccacca

SEQ ID NO: 22900 - DNA, 98 bp, synthetic construct
  misc_feature 1..98: note = muag-v2 3'-UTR
  source 1..98: mol_type = other DNA
ggactagttataagactgactagcccgatgggcctcccaacgggccctcctcccctccttgcaccgagagatctcaaaggctcttttcagagccacca

SEQ ID NO: 22901 - RNA, 98 nt, synthetic construct
  misc_feature 1..98: note = muag-v2 3'-UTR
  source 1..98: mol_type = other RNA
ggactagttataagactgactagcccgatgggcctcccaacgggccctcctcccctccttgcaccgagagatctcaaaggctcttttcagagccacca

SEQ ID NO: 22902 - DNA, 71 bp, synthetic construct
  misc_feature 1..71: note = PSMB3-v2 3'-UTR
  source 1..71: mol_type = other DNA
ggactagtccctgttcccagagcccacttttttttctttttttgaaataaaatagcctgtctttcagatct

SEQ ID NO: 22903 - RNA, 71 nt, synthetic construct
  misc_feature 1..71: note = PSMB3-v2 3'-UTR
  source 1..71: mol_type = other RNA
ggactagtccctgttcccagagcccacttttttttctttttttgaaataaaatagcctgtctttcagatct

SEQ ID NO: 22904 - DNA, 84 bp, synthetic construct
  misc_feature 1..84: note = RPS9-v2 3'-UTR
  source 1..84: mol_type = other DNA
ggactagtgtccacctgtccctcctgggctgctggattgtctcgttttcctgccaaataaacaggatcagcgctttacagatct

SEQ ID NO: 22905 - RNA, 84 nt, synthetic construct
  misc_feature 1..84: note = RPS9-v2 3'-UTR
  source 1..84: mol_type = other RNA
ggactagtgtccacctgtccctcctgggctgctggattgtctcgttttcctgccaaataaacaggatcagcgctttacagatct

SEQ ID NO: 22906 - DNA, 74 bp, synthetic construct
  misc_feature 1..74: note = muag-v2 3'-UTR
  source 1..74: mol_type = other DNA
ggactagttataagactgactagcccgatgggcctcccaacgggccctcctcccctccttgcaccgagattaat

SEQ ID NO: 22907 - RNA, 74 nt, synthetic construct
  misc_feature 1..74: note = muag-v2 3'-UTR
  source 1..74: mol_type = other RNA
ggactagttataagactgactagcccgatgggcctcccaacgggccctcctcccctccttgcaccgagattaat

SEQ ID NO: 22908 - DNA, 80 bp, synthetic construct
  misc_feature 1..80: note = muag-v2 3'-UTR
  source 1..80: mol_type = other DNA
ggactagttataagactgactagcccgatgggcctcccaacgggccctcctcccctccttgcaccgagattaatagatct

SEQ ID NO: 22909 - RNA, 80 nt, synthetic construct
  misc_feature 1..80: note = muag-v2 3'-UTR
  source 1..80: mol_type = other RNA
ggactagttataagactgactagcccgatgggcctcccaacgggccctcctcccctccttgcaccgagattaatagatct

SEQ ID NO: 22910 - DNA, 74 bp, synthetic construct
  misc_feature 1..74: note = muag-v2 3'-UTR
  source 1..74: mol_type = other DNA
ggactagttataagactgactagcccgatgggcctcccaacgggccctcctcccctccttgcaccgagagatct

SEQ ID NO: 22911 - RNA, 74 nt, synthetic construct
  misc_feature 1..74: note = muag-v2 3'-UTR
  source 1..74: mol_type = other RNA
ggactagttataagactgactagcccgatgggcctcccaacgggccctcctcccctccttgcaccgagagatct

SEQ ID NO: 22912 - RNA, 105 nt, synthetic construct
  misc_feature 1..105: note = mRNA 3'-end A100-N5
  source 1..105: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 22913 - RNA, 110 nt, synthetic construct
  misc_feature 1..110: note = mRNA 3'-end A30-N10-A70
  source 1..110: mol_type = other RNA
aaaaaaaaaaaaaaaaaaaaaaaaaaaaaagcatatgactaaaaaaaaaaaaaaaaaaaaaaaaaaaaaaaaaaaaaaaaaaaaaaaaaaaaaaaaaaaaaaaaaaaaaa

SEQ ID NO: 22914 - RNA, 669 nt, synthetic construct
  misc_feature 1..669: note = SARS-CoV-2/Wuhan/WIV05/2019__EPI_ISL_402128 spike protein CDS gc (319-541)
  source 1..669: mol_type = other RNA
cgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttc

SEQ ID NO: 22915 - RNA, 669 nt, synthetic construct
  misc_feature 1..669: note = SARS-CoV-2/Wuhan/WIV05/2019__EPI_ISL_402128 spike protein CDS gc mod (334-528)
  source 1..669: mol_type = other RNA
cgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttc

SEQ ID NO: 22916 - RNA, 669 nt, synthetic construct
  misc_feature 1..669: note = SARS-CoV-2/Wuhan/WIV05/2019__EPI_ISL_402128 spike protein CDS gc mod (319-541)
  source 1..669: mol_type = other RNA
agagtgcagccaacagaatctattgtgagatttccaaatattacaaatctgtgtccatttggagaagtgtttaatgcaacaagatttgcatctgtgtatgcatggaatagaaaaagaatttctaattgtgtggctgattattctgtgctgtataatagtgcttctttttccacatttaaatgttatggagtgtctccaacaaaattaaatgatttatgttttacaaatgtgtatgctgattcttttgtgatcagaggtgatgaagtgagacagattgcccccggacagacaggaaaaattgctgattacaattacaaactgcctgatgattttacaggatgtgtgattgcttggaattctaataatttagattctaaagtgggaggaaattacaattatctgtacagactgtttagaaaatcaaatctgaaaccttttgaaagagatatttcaacagaaatttatcaggctggatcaacaccttgtaatggagtggaaggatttaattgttattttccattacagagctatggatttcagccaaccaatggtgtgggatatcagccatatagagtggtggtgctgtcttttgaactgctgcatgcacctgcaacagtgtgtggacctaaaaaatcaacaaatctggtgaaaaataaatgtgtgaatttt

SEQ ID NO: 22917 - protein, 195 aa, synthetic construct
  REGION 1..195: note = SARS-CoV-2/Wuhan/WIV05/2019__EPI_ISL_402128 spike protein (334-528)
NLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPK

SEQ ID NO: 22918 - RNA, 585 nt, synthetic construct
  misc_feature 1..585: note = SARS-CoV-2/Wuhan/WIV05/2019__EPI_ISL_402128 spike protein CDS gc (334-528)
  source 1..585: mol_type = other RNA
aacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaag

SEQ ID NO: 22919 - RNA, 585 nt, synthetic construct
  misc_feature 1..585: note = SARS-CoV-2/Wuhan/WIV05/2019__EPI_ISL_402128 spike protein CDS gc (334-528)
  source 1..585: mol_type = other RNA
aacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaag

SEQ ID NO: 22920 - RNA, 606 nt, synthetic construct
  misc_feature 1..606: note = SARS-CoV-2/Wuhan/WIV05/2019__EPI_ISL_402128 spike protein CDS gc mod (334-528)
  source 1..606: mol_type = other RNA
gtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaag

SEQ ID NO: 22921 - RNA, 585 nt, synthetic construct
  misc_feature 1..585: note = SARS-CoV-2/Wuhan/WIV05/2019__EPI_ISL_402128 spike protein CDS gc mod (334-528)
  source 1..585: mol_type = other RNA
aatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaag

SEQ ID NO: 22922 - RNA, 585 nt, synthetic construct
  misc_feature 1..585: note = SARS-CoV-2/Wuhan/WIV05/2019__EPI_ISL_402128 spike protein CDS gc mod (334-528)
  source 1..585: mol_type = other RNA
aatctgtgtccatttggagaagtgtttaatgcaacaagatttgcatctgtgtatgcatggaatagaaaaagaatttctaattgtgtggctgattattctgtgctgtataatagtgcttctttttccacatttaaatgttatggagtgtctccaacaaaattaaatgatttatgttttacaaatgtgtatgctgattcttttgtgatcagaggtgatgaagtgagacagattgcccccggacagacaggaaaaattgctgattacaattacaaactgcctgatgattttacaggatgtgtgattgcttggaattctaataatttagattctaaagtgggaggaaattacaattatctgtacagactgtttagaaaatcaaatctgaaaccttttgaaagagatatttcaacagaaatttatcaggctggatcaacaccttgtaatggagtggaaggatttaattgttattttccattacagagctatggatttcagccaaccaatggtgtgggatatcagccatatagagtggtggtgctgtcttttgaactgctgcatgcacctgcaacagtgtgtggacctaaa

SEQ ID NO: 22923 - protein, 202 aa, synthetic construct
  REGION 1..202: note = SARS-CoV-2/Wuhan/WIV05/2019__EPI_ISL_402128 spike protein (327-528)
VRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPK

SEQ ID NO: 22924 - RNA, 606 nt, synthetic construct
  misc_feature 1..606: note = SARS-CoV-2/Wuhan/WIV05/2019__EPI_ISL_402128 spike protein CDS gc (327-528)
  source 1..606: mol_type = other RNA
gtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaag

SEQ ID NO: 22925 - RNA, 606 nt, synthetic construct
  misc_feature 1..606: note = SARS-CoV-2/Wuhan/WIV05/2019__EPI_ISL_402128 spike protein CDS gc (327-528)
  source 1..606: mol_type = other RNA
gtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaag

SEQ ID NO: 22926 - RNA, 606 nt, synthetic construct; identical to SEQ ID NO: 22920
  misc_feature 1..606: note = SARS-CoV-2/Wuhan/WIV05/2019__EPI_ISL_402128 spike protein CDS gc mod (327-528)
  source 1..606: mol_type = other RNA

SEQ ID NO: 22927 - RNA, 606 nt, synthetic construct
  misc_feature 1..606: note = SARS-CoV-2/Wuhan/WIV05/2019__EPI_ISL_402128 spike protein CDS gc mod (327-528)
  source 1..606: mol_type = other RNA
gtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaag

SEQ ID NO: 22928 - RNA, 606 nt, synthetic construct
  misc_feature 1..606: note = SARS-CoV-2/Wuhan/WIV05/2019__EPI_ISL_402128 spike protein CDS gc mod (327-528)
  source 1..606: mol_type = other RNA
gtgagatttccaaatattacaaatctgtgtccatttggagaagtgtttaatgcaacaagatttgcatctgtgtatgcatggaatagaaaaagaatttctaattgtgtggctgattattctgtgctgtataatagtgcttctttttccacatttaaatgttatggagtgtctccaacaaaattaaatgatttatgttttacaaatgtgtatgctgattcttttgtgatcagaggtgatgaagtgagacagattgcccccggacagacaggaaaaattgctgattacaattacaaactgcctgatgattttacaggatgtgtgattgcttggaattctaataatttagattctaaagtgggaggaaattacaattatctgtacagactgtttagaaaatcaaatctgaaaccttttgaaagagatatttcaacagaaatttatcaggctggatcaacaccttgtaatggagtggaaggatttaattgttattttccattacagagctatggatttcagccaaccaatggtgtgggatatcagccatatagagtggtggtgctgtcttttgaactgctgcatgcacctgcaacagtgtgtggacctaaa

SEQ ID NO: 22929 - protein, 1273 aa, synthetic construct; identical to SEQ ID NO: 1
  REGION 1..1273: note = SARS-CoV-2/Wuhan/WIV05/2019__EPI_ISL_402128 spike protein (1-1273)

SEQ ID NO: 22930 - protein, 1273 aa, synthetic construct; identical to SEQ ID NO: 9
  REGION 1..1273: note = SARS-CoV-2/Wuhan/WIV05/2019__EPI_ISL_402128 spike protein (1-1273)(D614G)

SEQ ID NO: 22931 - protein, 1273 aa, synthetic construct; identical to SEQ ID NO: 22739
  REGION 1..1273: note = SARS-CoV-2/Wuhan/WIV05/2019__EPI_ISL_402128 spike protein (1-1273)(A222V_D614G)

SEQ ID NO: 22932 - protein, 1273 aa, synthetic construct; identical to SEQ ID NO: 22741
  REGION 1..1273: note = SARS-CoV-2/Wuhan/WIV05/2019__EPI_ISL_402128 spike protein (1-1273)(N439K_D614G)

SEQ ID NO: 22933 - protein, 1273 aa, synthetic construct; identical to SEQ ID NO: 22743
  REGION 1..1273: note = SARS-CoV-2/Wuhan/WIV05/2019__EPI_ISL_402128 spike protein (1-1273)(S477N_D614G)

SEQ ID NO: 22934 - protein, 1273 aa, synthetic construct; identical to SEQ ID NO: 22745
  REGION 1..1273: note = SARS-CoV-2/Wuhan/WIV05/2019__EPI_ISL_402128 spike protein (1-1273)(N501Y_D614G)

SEQ ID NO: 22935 - protein, 1271 aa, synthetic construct; identical to SEQ ID NO: 22747
  REGION 1..1271: note = SARS-CoV-2/Wuhan/WIV05/2019__EPI_ISL_402128 spike protein (1-1273)(H69del_V70del_D614G)

SEQ ID NO: 22936 - protein, 1273 aa, synthetic construct; identical to SEQ ID NO: 22749
  REGION 1..1273: note = SARS-CoV-2/Wuhan/WIV05/2019__EPI_ISL_402128 spike protein (1-1273)(Y453F_D614G)

SEQ ID NO: 22937 - protein, 1273 aa, synthetic construct; identical to SEQ ID NO: 22751
  REGION 1..1273: note = SARS-CoV-2/Wuhan/WIV05/2019__EPI_ISL_402128 spike protein (1-1273)(D614G_I692V)

SEQ ID NO: 22938 - protein, 1273 aa, synthetic construct; identical to SEQ ID NO: 327
  REGION 1..1273: note = SARS-CoV-2/Wuhan/WIV05/2019__EPI_ISL_402128 spike protein (1-1273)(D614G_M1229I)

SEQ ID NO: 22939 - protein, 1271 aa, synthetic construct; identical to SEQ ID NO: 22755
  REGION 1..1271: note = SARS-CoV-2/Wuhan/WIV05/2019__EPI_ISL_402128 spike protein (1-1273)(H69del_V70del_A222V_Y453F_S477N_D614G_I692V)

SEQ ID NO: 22940 - protein, 1271 aa, synthetic construct; identical to SEQ ID NO: 22757
  REGION 1..1271: note = SARS-CoV-2/Wuhan/WIV05/2019__EPI_ISL_402128 spike protein (1-1273)(H69del_V70del_Y453F_D614G_I692V_M1229I)

SEQ ID NO: 22941 - protein, 1270 aa, synthetic construct
  REGION 1..1270: note = SARS-CoV-2/Wuhan/WIV05/2019__EPI_ISL_402128 spike protein (1-1273)(H69del_V70del_Y144del_N501Y_A570D_D614G_P681H_T716 I_S982A_D1118H)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22942 - protein, 1273 aa, synthetic construct
  REGION 1..1273: note = SARS-CoV-2/Wuhan/WIV05/2019__EPI_ISL_402128 spike protein (1-1273)(K417N_E484K_N501Y_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22943 - protein, 1270 aa, synthetic construct
  REGION 1..1270: note = SARS-CoV-2/Wuhan/WIV05/2019__EPI_ISL_402128 spike protein (1-1273)(L18F_D80A_D215G_L242del_A243del_L244del_R246I_K417 N_E484K_N501Y_D614G_A701V)
MFVFLVLLPLVSSQCVNFTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHISYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22944 - protein, 1273 aa, synthetic construct
  REGION 1..1273: note = SARS-CoV-2/Wuhan/WIV05/2019__EPI_ISL_402128 spike protein (1-1273)(E484K_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22945 - protein, 1273 aa, synthetic construct
  REGION 1..1273: note = SARS-CoV-2/Wuhan/WIV05/2019__EPI_ISL_402128 spike protein (1-1273)(L18F_T20N_P26S_D138Y_R190S_K417T_E484K_N501Y_D614G _H655Y_T1027I)
MFVFLVLLPLVSSQCVNFTNRTQLPSAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNYPFLGVYYHKNNKSWMESEFRVYSSANNCTFEYVSQPFLMDLEGKQGNFKNLSEFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22946 - protein, 1273 aa, synthetic construct
  REGION 1..1273: note = SARS-CoV-2/Wuhan/WIV05/2019__EPI_ISL_402128 spike protein (1-1273)(S13I_W152C_L452R_D614G)
MFVFLVLLPLVSIQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSCMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22947 - protein, 1273 aa, synthetic construct; identical to SEQ ID NO: 10
  REGION 1..1273: note = SARS-CoV-2/Wuhan/WIV05/2019__EPI_ISL_402128 spike protein (1-1273)(K986P_V987P)

SEQ ID NO: 22948 - protein, 1273 aa, synthetic construct; identical to SEQ ID NO: 18
  REGION 1..1273: note = SARS-CoV-2/Wuhan/WIV05/2019__EPI_ISL_402128 spike protein (1-1273)(K986P_V987P_ D614G)

SEQ ID NO: 22949 - protein, 1273 aa, synthetic construct; identical to SEQ ID NO: 22740
  REGION 1..1273: note = SARS-CoV-2/Wuhan/WIV05/2019__EPI_ISL_402128 spike protein (1-1273)(K986P_V987P_A222V_D614G)

SEQ ID NO: 22950 - protein, 1273 aa, synthetic construct; identical to SEQ ID NO: 22742
  REGION 1..1273: note = SARS-CoV-2/Wuhan/WIV05/2019__EPI_ISL_402128 spike protein (1-1273)(K986P_V987P_N439K_D614G)

SEQ ID NO: 22951 - protein, 1273 aa, synthetic construct; identical to SEQ ID NO: 22744
  REGION 1..1273: note = SARS-CoV-2/Wuhan/WIV05/2019__EPI_ISL_402128 spike protein (1-1273)(K986P_V987P_S477N_D614G)

SEQ ID NO: 22952 - protein, 1273 aa, synthetic construct; identical to SEQ ID NO: 22746
  REGION 1..1273: note = SARS-CoV-2/Wuhan/WIV05/2019__EPI_ISL_402128 spike protein (1-1273)(K986P_V987P_N501Y_D614G)

SEQ ID NO: 22953 - protein, 1271 aa, synthetic construct; identical to SEQ ID NO: 22748
  REGION 1..1271: note = SARS-CoV-2/Wuhan/WIV05/2019__EPI_ISL_402128 spike protein (1-1273)(K986P_V987P_H69del_V70del_D614G)

SEQ ID NO: 22954 - protein, 1273 aa, synthetic construct; identical to SEQ ID NO: 22750
  REGION 1..1273: note = SARS-CoV-2/Wuhan/WIV05/2019__EPI_ISL_402128 spike protein (1-1273)(K986P_V987P_Y453F_D614G)

SEQ ID NO: 22955 - protein, 1273 aa, synthetic construct; identical to SEQ ID NO: 22752
  REGION 1..1273: note = SARS-CoV-2/Wuhan/WIV05/2019__EPI_ISL_402128 spike protein (1-1273)(K986P_V987P_D614G_I692V)

SEQ ID NO: 22956 - protein, 1273 aa, synthetic construct; identical to SEQ ID NO: 394
  REGION 1..1273: note = SARS-CoV-2/Wuhan/WIV05/2019__EPI_ISL_402128 spike protein (1-1273)(K986P_V987P_D614G_M1229I)

SEQ ID NO: 22957 - protein, 1271 aa, synthetic construct; identical to SEQ ID NO: 22756
  REGION 1..1271: note = SARS-CoV-2/Wuhan/WIV05/2019__EPI_ISL_402128 spike protein (1-1273)(K986P_V987P_H69del_V70del_A222V_Y453F_S477N_D614G_ I692V)

SEQ ID NO: 22958 - protein, 1271 aa, synthetic construct; identical to SEQ ID NO: 22758
  REGION 1..1271: note = SARS-CoV-2/Wuhan/WIV05/2019__EPI_ISL_402128 spike protein (1-1273)(K986P_V987P_H69del_V70del_Y453F_D614G_I692V_M1229I )

SEQ ID NO: 22959 - protein, 1270 aa, synthetic construct
  REGION 1..1270: note = SARS-CoV-2/Wuhan/WIV05/2019__EPI_ISL_402128 spike protein (1-1273)(K986P_V987P_K986P_V987P_H69del_V70del_Y144del_N501 Y_A570D_D614G_P681H_T716I_S982A_D1118H)
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22960 - protein, 1273 aa, synthetic construct
  REGION 1..1273: note = SARS-CoV-2/Wuhan/WIV05/2019__EPI_ISL_402128 spike protein (1-1273)(K986P_V987P_K986P_V987P_K417N_E484K_N501Y_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22961 - protein, 1270 aa, synthetic construct
  REGION 1..1270: note = SARS-CoV-2/Wuhan/WIV05/2019__EPI_ISL_402128 spike protein (1-1273)(K986P_V987P_K986P_V987P_L18F_D80A_D215G_L242del_A2 43del_L244del_R246I_K417N_E484K_N501Y_D614G_A701V)
MFVFLVLLPLVSSQCVNFTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHISYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22962 - protein, 1273 aa, synthetic construct
  REGION 1..1273: note = SARS-CoV-2/Wuhan/WIV05/2019__EPI_ISL_402128 spike protein (1-1273)(K986P_V987P_K986P_V987P_E484K_D614G)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22963 - protein, 1273 aa, synthetic construct
  REGION 1..1273: note = SARS-CoV-2/Wuhan/WIV05/2019__EPI_ISL_402128 spike protein (1-1273)(K986P_V987P_K986P_V987P_L18F_T20N_P26S_D138Y_R190S _K417T_E484K_N501Y_D614G_H655Y_T1027I)
MFVFLVLLPLVSSQCVNFTNRTQLPSAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNYPFLGVYYHKNNKSWMESEFRVYSSANNCTFEYVSQPFLMDLEGKQGNFKNLSEFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22964 - protein, 1273 aa, synthetic construct
  REGION 1..1273: note = SARS-CoV-2/Wuhan/WIV05/2019__EPI_ISL_402128 spike protein (1-1273)(K986P_V987P_K986P_V987P_S13I_W152C_L452R_D614G)
MFVFLVLLPLVSIQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSCMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 22965 - RNA, 1152 nt, synthetic construct; identical to SEQ ID NO: 22760
  misc_feature 1..1152: note = SARS-CoV-2/Wuhan/WIV05/2019__EPI_ISL_402128 spike protein CDS gc (1-15,334-528) Ferritin construct
  source 1..1152: mol_type = other RNA

SEQ ID NO: 22966 - RNA, 750 nt, synthetic construct; identical to SEQ ID NO: 22761
  misc_feature 1..750: note = SARS-CoV-2/Wuhan/WIV05/2019__EPI_ISL_402128 spike protein CDS gc (334-528) Foldon construct
  source 1..750: mol_type = other RNA

SEQ ID NO: 22967 - RNA, 1128 nt, synthetic construct; identical to SEQ ID NO: 22762
  misc_feature 1..1128: note = SARS-CoV-2/Wuhan/WIV05/2019__EPI_ISL_402128 spike protein CDS gc (1-15,334-528) LumSynth construct
  source 1..1128: mol_type = other RNA

SEQ ID NO: 22968 - RNA, 1089 nt, synthetic construct; identical to SEQ ID NO: 22763
  misc_feature 1..1089: note = SARS-CoV-2/Wuhan/WIV05/2019__EPI_ISL_402128 spike protein CDS gc (334-528) LumSynth construct
  source 1..1089: mol_type = other RNA

SEQ ID NO: 22969 - RNA, 3822 nt, synthetic construct; identical to SEQ ID NO: 136
  misc_feature 1..3822: note = SARS-CoV-2/Wuhan/WIV05/2019__EPI_ISL_402128 spike protein CDS gc (1-1273)
  source 1..3822: mol_type = other RNA

SEQ ID NO: 22970 - RNA, 3822 nt, synthetic construct; identical to SEQ ID NO: 22764
  misc_feature 1..3822: note = SARS-CoV-2/Wuhan/WIV05/2019__EPI_ISL_402128 spike protein CDS gc (1-1273)(D614G)
  source 1..3822: mol_type = other RNA

SEQ ID NO: 22971 - RNA, 3822 nt, synthetic construct; identical to SEQ ID NO: 22766
  misc_feature 1..3822: note = SARS-CoV-2/Wuhan/WIV05/2019__EPI_ISL_402128 spike protein CDS gc (1-1273)(A222V_D614G)
  source 1..3822: mol_type = other RNA

SEQ ID NO: 22972 - RNA, 3822 nt, synthetic construct; identical to SEQ ID NO: 22768
  misc_feature 1..3822: note = SARS-CoV-2/Wuhan/WIV05/2019__EPI_ISL_402128 spike protein CDS gc (1-1273)(N439K_D614G)
  source 1..3822: mol_type = other RNA

SEQ ID NO: 22973 - RNA, 3822 nt, synthetic construct; identical to SEQ ID NO: 22770
  misc_feature 1..3822: note = SARS-CoV-2/Wuhan/WIV05/2019__EPI_ISL_402128 spike protein CDS gc (1-1273)(S477N_D614G)
  source 1..3822: mol_type = other RNA

SEQ ID NO: 22974 - RNA, 3822 nt, synthetic construct; identical to SEQ ID NO: 22772
  misc_feature 1..3822: note = SARS-CoV-2/Wuhan/WIV05/2019__EPI_ISL_402128 spike protein CDS gc (1-1273)(N501Y_D614G)
  source 1..3822: mol_type = other RNA

SEQ ID NO: 22975 - RNA, 3816 nt, synthetic construct; identical to SEQ ID NO: 22774
  misc_feature 1..3816: note = SARS-CoV-2/Wuhan/WIV05/2019__EPI_ISL_402128 spike protein CDS gc (1-1273)(H69del_V70del_D614G)
  source 1..3816: mol_type = other RNA

SEQ ID NO: 22976 - RNA, 3822 nt, synthetic construct; identical to SEQ ID NO: 22776
  misc_feature 1..3822: note = SARS-CoV-2/Wuhan/WIV05/2019__EPI_ISL_402128 spike protein CDS gc (1-1273)(Y453F_D614G)
  source 1..3822: mol_type = other RNA

SEQ ID NO: 22977 - RNA, 3822 nt, synthetic construct; identical to SEQ ID NO: 22778
  misc_feature 1..3822: note = SARS-CoV-2/Wuhan/WIV05/2019__EPI_ISL_402128 spike protein CDS gc (1-1273)(D614G_I692V)
  source 1..3822: mol_type = other RNA

SEQ ID NO: 22978 - RNA, 3822 nt, synthetic construct; identical to SEQ ID NO: 22780
  misc_feature 1..3822: note = SARS-CoV-2/Wuhan/WIV05/2019__EPI_ISL_402128 spike protein CDS gc (1-1273)(D614G_M1229I)
  source 1..3822: mol_type = other RNA

SEQ ID NO: 22979 - RNA, 3816 nt, synthetic construct; identical to SEQ ID NO: 22782
  misc_feature 1..3816: note = SARS-CoV-2/Wuhan/WIV05/2019__EPI_ISL_402128 spike protein CDS gc (1-1273)(H69del_V70del_A222V_Y453F_S477N_D614G_I692V)
  source 1..3816: mol_type = other RNA

SEQ ID NO: 22980 - RNA, 3816 nt, synthetic construct; identical to SEQ ID NO: 22784
  misc_feature 1..3816: note = SARS-CoV-2/Wuhan/WIV05/2019__EPI_ISL_402128 spike protein CDS gc (1-1273)(H69del_V70del_Y453F_D614G_I692V_M1229I)
  source 1..3816: mol_type = other RNA

SEQ ID NO: 22981 - RNA, 3813 nt, synthetic construct
  misc_feature 1..3813: note = SARS-CoV-2/Wuhan/WIV05/2019__EPI_ISL_402128 spike protein CDS gc (1-1273)(H69del_V70del_Y144del_N501Y_A570D_D614G_P681H_T716 I_S982A_D1118H)
  source 1..3813: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22982 - RNA, 3822 nt, synthetic construct
  misc_feature 1..3822: note = SARS-CoV-2/Wuhan/WIV05/2019__EPI_ISL_402128 spike protein CDS gc (1-1273)(K417N_E484K_N501Y_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22983 - RNA, 3813 nt, synthetic construct
  misc_feature 1..3813: note = SARS-CoV-2/Wuhan/WIV05/2019__EPI_ISL_402128 spike protein CDS gc (1-1273)(L18F_D80A_D215G_L242del_A243del_L244del_R246I_K417 N_E484K_N501Y_D614G_A701V)
  source 1..3813: mol_type = other RNA
atgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22984 - RNA, 3822 nt, synthetic construct
  misc_feature 1..3822: note = SARS-CoV-2/Wuhan/WIV05/2019__EPI_ISL_402128 spike protein CDS gc (1-1273)(E484K_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22985 - RNA, 3822 nt, synthetic construct
  misc_feature 1..3822: note = SARS-CoV-2/Wuhan/WIV05/2019__EPI_ISL_402128 spike protein CDS gc (1-1273)(L18F_T20N_P26S_D138Y_R190S_K417T_E484K_N501Y_D614G _H655Y_T1027I)
  source 1..3822: mol_type = other RNA
atgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22986 - RNA, 3822 nt, synthetic construct
  misc_feature 1..3822: note = SARS-CoV-2/Wuhan/WIV05/2019__EPI_ISL_402128 spike protein CDS gc (1-1273)(S13I_W152C_L452R_D614G)
  source 1..3822: mol_type = other RNA
atgttcgtgttcctggtcctcctgcccctggtgagcatccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctgcatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 22987 - RNA, 3822 nt, synthetic construct; identical to SEQ ID NO: 136
  misc_feature 1..3822: note = SARS-CoV-2/Wuhan/WIV05/2019__EPI_ISL_402128 spike protein CDS gc (1-1273)
  source 1..3822: mol_type = other RNA

SEQ ID NO: 22988 - RNA, 3822 nt, synthetic construct; identical to SEQ ID NO: 11739
  misc_feature 1..3822: note = SARS-CoV-2/Wuhan/WIV05/2019__EPI_ISL_402128 spike protein CDS gc (1-1273)(D614G)
  source 1..3822: mol_type = other RNA

SEQ ID NO: 22989 - RNA, 3822 nt, synthetic construct
  misc_feature 1..3822: note = SARS-CoV-2/Wuhan/WIV05/2019__EPI_ISL_402128 spike protein CDS gc (1-1273)(A222V_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgtgctcgagcccctggtggacctgcccatcggcatcaacatcacccgcttccagaccctcctggccctgcaccggtcctacctcacgccgggggacagcagctccggctggaccgccggcgcggccgcctactacgtcgggtacctgcagccccgcaccttcctgctcaagtacaacgagaacggcaccatcacggacgccgtggactgcgcgctggaccccctgagcgagaccaagtgcaccctcaagtccttcaccgtggagaaggggatctaccagacgagcaacttccgggtccagcccaccgagtccatcgtgcgcttcccgaacatcaccaacctgtgccccttcggcgaggtcttcaacgccacccggttcgccagcgtgtacgcctggaaccgcaagcggatctccaactgcgtggccgactacagcgtcctgtacaactccgcgagcttctccacgttcaagtgctacggcgtgagccccaccaagctcaacgacctgtgcttcaccaacgtgtacgccgactccttcgtcatccgcggggacgaggtgcggcagatcgcccccggccagaccgggaagatcgccgactacaactacaagctgccggacgacttcacgggctgcgtgatcgcctggaacagcaacaacctcgactccaaggtcgggggcaactacaactacctgtaccgcctgttccgcaagagcaacctcaagcccttcgagcgggacatctccaccgagatctaccaggcgggcagcaccccctgcaacggggtggagggcttcaactgctacttccccctgcagtcctacgggttccagccgaccaacggcgtggggtaccagccctaccgggtcgtggtgctgagcttcgagctcctgcacgcccccgccacggtctgcggccccaagaagtccaccaacctggtgaagaacaagtgcgtgaacttcaacttcaacggcctcaccgggaccggcgtcctgaccgagagcaacaagaagttcctgccgttccagcagttcgggcgcgacatcgccgacacgaccgacgccgtgcgcgacccccagaccctggagatcctcgacatcaccccctgcagcttcggcggggtgtccgtcatcacgccgggcaccaacaccagcaaccaggtggcggtgctgtaccagggcgtcaactgcaccgaggtgcccgtggccatccacgccgaccagctgacgcccacctggcgggtctactccaccgggagcaacgtgttccagacccgcgccggctgcctcatcggggccgagcacgtgaacaactcctacgagtgcgacatccccatcggcgcgggcatctgcgccagctaccagacgcagaccaactccccgcggcgcgcccggagcgtcgcctcccagagcatcatcgcgtacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgccctgacgggcatcgcggtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacaccagcgccctcctggccggcaccatcacgtccgggtggaccttcggcgcgggcgccgccctgcagatccccttcgccatgcagatggcgtaccggttcaacgggatcggcgtgacccagaacgtgctctacgagaaccagaagctgatcgccaaccagttcaacagcgccatcgggaagatccaggactccctgagctccaccgccagcgccctcggcaagctgcaggacgtcgtgaaccagaacgcgcaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggccgcggagatccgcgccagcgccaacctcgccgccaccaagatgtccgagtgcgtgctgggccagagcaagcgggtggacttctgcgggaagggctaccacctgatgtccttcccccagagcgcgccgcacggggtcgtgttcctccacgtcacgtacgtgcccgcccaggagaagaacttcaccaccgcccccgccatctgccacgacggcaaggcgcacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgccatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtga

SEQ ID NO: 22990 - RNA, 3822 nt, synthetic construct
  misc_feature 1..3822: note = SARS-CoV-2/Wuhan/WIV05/2019__EPI_ISL_402128 spike protein CDS gc (1-1273)(N439K_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaagaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 22991 - RNA, 3822 nt, synthetic construct
  misc_feature 1..3822: note = SARS-CoV-2/Wuhan/WIV05/2019__EPI_ISL_402128 spike protein CDS gc (1-1273)(S477N_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgagcgtgatcacgccgggcaccaacacctccaaccaggtcgccgtgctgtaccagggcgtgaactgcaccgaggtccccgtggccatccacgccgaccagctgacgcccacctggcgggtgtacagcaccgggtccaacgtcttccagacccgcgccggctgcctcatcggggcggagcacgtgaacaacagctacgagtgcgacatccccatcggcgccggcatctgcgcctcctaccagacgcagaccaacagcccgcggcgcgcccggtccgtggcgagccagtccatcatcgcctacaccatgagcctgggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctcctgctgcagtacgggagcttctgcacccagctcaaccgcgcgctgacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacacctccgccctcctggcgggcaccatcacgagcgggtggaccttcggcgccggcgccgccctgcagatccccttcgcgatgcagatggcctaccggttcaacgggatcggcgtcacccagaacgtgctctacgagaaccagaagctgatcgccaaccagttcaactccgccatcgggaagatccaggacagcctgtccagcaccgcctccgcgctcggcaagctgcaggacgtggtcaaccagaacgcccaggccctgaacacgctcgtgaagcagctgagctccaacttcggggccatcagctccgtgctgaacgacatcctcagccgcctggacaaggtcgaggccgaggtgcagatcgaccggctgatcaccggccgcctccagtccctgcagacctacgtgacccagcagctgatccgggcggccgagatccgcgccagcgccaacctcgccgcgaccaagatgagcgagtgcgtcctgggccagtccaagcgggtggacttctgcgggaagggctaccacctgatgagcttcccccagtccgccccgcacggggtggtcttcctccacgtgacgtacgtccccgcccaggagaagaacttcaccaccgcccccgcgatctgccacgacggcaaggcccacttcccccgcgagggggtgttcgtgagcaacggcacccactggttcgtcacgcagcggaacttctacgagccgcagatcatcaccaccgacaacaccttcgtgtccggcaactgcgacgtggtcatcgggatcgtgaacaacacggtgtacgaccccctgcagcccgagctggacagcttcaaggaggagctcgacaagtacttcaagaaccacacctcccccgacgtcgacctgggcgacatcagcgggatcaacgcctccgtggtgaacatccagaaggagatcgaccgcctgaacgaggtcgccaagaacctcaacgagagcctgatcgacctgcaggagctcggcaagtacgagcagtacatcaagtggccgtggtacatctggctgggcttcatcgccgggctgatcgcgatcgtgatggtgaccatcatgctctgctgcatgacctcctgctgcagctgcctgaagggctgctgctcctgcgggagctgctgcaagttcgacgaggacgactccgagcccgtcctgaagggcgtgaagctccactacacgtga

SEQ ID NO: 22992 - RNA, 3822 nt, synthetic construct
  misc_feature 1..3822: note = SARS-CoV-2/Wuhan/WIV05/2019__EPI_ISL_402128 spike protein CDS gc (1-1273)(N501Y_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 22993 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_D614G)
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtggcctactccaacaacagcatcgccatccccaccaacttcacgatctccgtcaccaccgagatcctgcccgtgagcatgaccaagacgagcgtggactgcaccatgtacatctgcggcgactccaccgagtgcagcaacctcctgctgcagtacgggtccttctgcacccagctcaaccgcgcgctgacgggcatcgccgtcgagcaggacaagaacacccaggaggtgttcgcccaggtgaagcagatctacaagacgcccccgatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtcctctacgagaaccagaagctgatcgccaaccagttcaacagcgccatcgggaagatccaggactccctgagctccaccgccagcgcgctcggcaagctgcaggacgtggtgaaccagaacgcccaggccctgaacacgctcgtcaagcagctgtccagcaacttcggggccatctccagcgtgctgaacgacatcctctcccgcctggacaaggtggaggccgaggtccagatcgaccggctgatcaccggccgcctccagagcctgcagacctacgtgacccagcagctgatccgggcggccgagatccgcgccagcgccaacctcgccgcgaccaagatgtccgagtgcgtgctgggccagagcaagcgggtcgacttctgcgggaagggctaccacctgatgtccttcccccagagcgccccgcacggggtggtgttcctccacgtcacgtacgtgcccgcccaggagaagaacttcaccaccgcccccgcgatctgccacgacggcaaggcccacttcccccgcgagggggtcttcgtgtccaacggcacccactggttcgtgacgcagcggaacttctacgagccgcagatcatcaccaccgacaacaccttcgtcagcggcaactgcgacgtggtgatcgggatcgtcaacaacacggtgtacgaccccctgcagcccgagctggactccttcaaggaggagctcgacaagtacttcaagaaccacaccagccccgacgtggacctgggcgacatctccgggatcaacgccagcgtcgtgaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtcatggtgaccatcatgctctgctgcatgaccagctgctgctcctgcctgaagggctgctgcagctgcgggtcctgctgcaagttcgacgaggacgacagcgagcccgtgctgaagggcgtcaagctccactacacgtga

SEQ ID NO: 22994 - RNA, 3822 nt, synthetic construct
  misc_feature 1..3822: note = SARS-CoV-2/Wuhan/WIV05/2019__EPI_ISL_402128 spike protein CDS gc (1-1273)(Y453F_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 22995 - RNA, 3822 nt, synthetic construct
  misc_feature 1..3822: note = SARS-CoV-2/Wuhan/WIV05/2019__EPI_ISL_402128 spike protein CDS gc (1-1273)(D614G_I692V)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcgtcatcgcctacaccatgtccctgggggccgagaacagcgtggcctactccaacaacagcatcgccatccccaccaacttcacgatctccgtgaccaccgagatcctgcccgtcagcatgaccaagacgagcgtggactgcaccatgtacatctgcggcgactccaccgagtgcagcaacctcctgctgcagtacgggtccttctgcacccagctcaaccgcgcgctgacgggcatcgccgtggagcaggacaagaacacccaggaggtcttcgcccaggtgaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtcctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtgacccagaacgtgctctacgagaaccagaagctgatcgccaaccagttcaacagcgccatcgggaagatccaggactccctgagctccaccgccagcgcgctcggcaagctgcaggacgtcgtgaaccagaacgcccaggccctgaacacgctcgtgaagcagctgtccagcaacttcggggccatctccagcgtcctgaacgacatcctctcccgcctggacaaggtggaggccgaggtgcagatcgaccggctgatcaccggccgcctccagagcctgcagacctacgtcacccagcagctgatccgggcggccgagatccgcgccagcgccaacctcgccgcgaccaagatgtccgagtgcgtgctgggccagagcaagcgggtggacttctgcgggaagggctaccacctgatgtccttcccccagagcgccccgcacggggtcgtgttcctccacgtcacgtacgtgcccgcccaggagaagaacttcaccaccgcccccgcgatctgccacgacggcaaggcccacttcccccgcgagggggtgttcgtctccaacggcacccactggttcgtgacgcagcggaacttctacgagccgcagatcatcaccaccgacaacaccttcgtgagcggcaactgcgacgtcgtgatcgggatcgtgaacaacacggtctacgaccccctgcagcccgagctggactccttcaaggaggagctcgacaagtacttcaagaaccacaccagccccgacgtggacctgggcgacatctccgggatcaacgccagcgtggtcaacatccagaaggagatcgaccgcctgaacgaggtggccaagaacctcaacgagtccctgatcgacctgcaggagctcggcaagtacgagcagtacatcaagtggccgtggtacatctggctgggcttcatcgccgggctgatcgcgatcgtgatggtcaccatcatgctctgctgcatgaccagctgctgctcctgcctgaagggctgctgcagctgcgggtcctgctgcaagttcgacgaggacgacagcgagcccgtgctgaagggcgtgaagctccactacacgtga

SEQ ID NO: 22996 - RNA, 3822 nt, synthetic construct; identical to SEQ ID NO: 11784
  misc_feature 1..3822: note = SARS-CoV-2/Wuhan/WIV05/2019__EPI_ISL_402128 spike protein CDS gc (1-1273)(D614G_M1229I)
  source 1..3822: mol_type = other RNA

SEQ ID NO: 22997 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_A222V_Y453F_S477N_D614G_I692V)
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgtcctcgagcccctggtggacctgcccatcggcatcaacatcacccgcttccagaccctcctggccctgcaccggtcctacctcacgccgggggacagcagctccggctggaccgccggcgcggccgcctactacgtggggtacctgcagccccgcaccttcctgctcaagtacaacgagaacggcaccatcacggacgccgtcgactgcgcgctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggccgactacagcgtgctgtacaactccgcgagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcctggaacagcaacaacctcgactccaaggtcgggggcaactacaactacctgttccgcctgttccgcaagagcaacctcaagcccttcgagcgggacatctccaccgagatctaccaggcgggcaacaccccctgcaacggggtggagggcttcaactgctacttccccctgcagagctacgggttccagccgaccaacggcgtggggtaccagccctaccgggtggtcgtgctgtccttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgccgtccgcgacccccagaccctggagatcctcgacatcaccccctgcagcttcggcggggtgagcgtgatcacgccgggcaccaacacctccaaccaggtcgcggtgctgtaccagggcgtgaactgcaccgaggtccccgtggccatccacgccgaccagctgacgcccacctggcgggtgtacagcaccgggtccaacgtcttccagacccgcgccggctgcctcatcggggccgagcacgtgaacaacagctacgagtgcgacatccccatcggcgcgggcatctgcgcctcctaccagacgcagaccaacagcccgcggcgcgcccggtccgtggccagccagtccgtcatcgcgtacaccatgagcctgggggccgagaactccgtggcctacagcaacaactccatcgccatccccaccaacttcacgatcagcgtgaccaccgagatcctgcccgtctccatgaccaagacgagcgtggactgcaccatgtacatctgcggcgacagcaccgagtgctccaacctcctgctgcagtacgggagcttctgcacccagctcaaccgcgccctgacgggcatcgcggtggagcaggacaagaacacccaggaggtcttcgcccaggtgaagcagatctacaagacgcccccgatcaaggacttcgggggcttcaacttctcccagatcctgcccgaccccagcaagccctccaagcggagcttcatcgaggacctcctgttcaacaaggtgaccctggccgacgccggcttcatcaagcagtacggggactgcctcggcgacatcgccgcgcgcgacctgatctgcgcccagaagttcaacgggctgaccgtcctcccgcccctgctgaccgacgagatgatcgcccagtacacctccgccctcctggccggcaccatcacgagcgggtggaccttcggcgcgggcgccgccctgcagatccccttcgccatgcagatggcgtaccggttcaacgggatcggcgtgacccagaacgtgctctacgagaaccagaagctgatcgccaaccagttcaactccgccatcgggaagatccaggacagcctgtccagcaccgcctccgccctcggcaagctgcaggacgtcgtgaaccagaacgcgcaggccctgaacacgctcgtgaagcagctgagctccaacttcggggccatcagctccgtcctgaacgacatcctcagccgcctggacaaggtggaggccgaggtgcagatcgaccggctgatcaccggccgcctccagtccctgcagacctacgtcacccagcagctgatccgggccgcggagatccgcgccagcgccaacctcgccgccaccaagatgagcgagtgcgtgctgggccagtccaagcgggtggacttctgcgggaagggctaccacctgatgagcttcccccagtccgcgccgcacggggtcgtgttcctccacgtcacgtacgtgcccgcccaggagaagaacttcaccaccgcccccgccatctgccacgacggcaaggcgcacttcccccgcgagggggtgttcgtcagcaacggcacccactggttcgtgacgcagcggaacttctacgagccgcagatcatcaccaccgacaacaccttcgtgtccggcaactgcgacgtcgtgatcgggatcgtgaacaacacggtctacgaccccctgcagcccgagctggacagcttcaaggaggagctcgacaagtacttcaagaaccacacctcccccgacgtggacctgggcgacatcagcgggatcaacgcctccgtggtcaacatccagaaggagatcgaccgcctgaacgaggtggccaagaacctcaacgagagcctgatcgacctgcaggagctcggcaagtacgagcagtacatcaagtggccgtggtacatctggctgggcttcatcgccgggctgatcgccatcgtgatggtcaccatcatgctctgctgcatgacctcctgctgcagctgcctgaagggctgctgctcctgcgggagctgctgcaagttcgacgaggacgactccgagcccgtgctgaagggcgtgaagctccactacacgtga

SEQ ID NO: 22998 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_Y453F_D614G_I692V_M1229I)
  source 1..3816: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtactaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgttccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgccgacacgaccgacgcggtgcgcgacccccagaccctggagatcctcgacatcaccccctgcagcttcggcggggtctccgtgatcacgccgggcaccaacaccagcaaccaggtggccgtcctgtaccagggcgtgaactgcaccgaggtgcccgtcgccatccacgccgaccagctgacgcccacctggcgggtgtactccaccgggagcaacgtgttccagacccgcgccggctgcctcatcggggcggagcacgtcaacaactcctacgagtgcgacatccccatcggcgccggcatctgcgccagctaccagacgcagaccaactccccgcggcgcgcccggagcgtggcgtcccagagcgtgatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatcgtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 22999 - RNA, 3813 nt, synthetic construct
  misc_feature 1..3813: note = SARS-CoV-2/Wuhan/WIV05/2019__EPI_ISL_402128 spike protein CDS gc (1-1273)(H69del_V70del_Y144del_N501Y_A570D_D614G_P681H_T716 I_S982A_D1118H)
  source 1..3813: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtgtacttcgcgagcaccgagaagtccaacatcatccgcggctggatcttcgggacgaccctcgacagcaagacccagtccctgctgatcgtcaacaacgccaccaacgtggtgatcaaggtctgcgagttccagttctgcaacgaccccttcctcggcgtgtaccacaagaacaacaagagctggatggagtccgagttccgggtgtacagctccgccaacaactgcacgttcgagtacgtcagccagcccttcctgatggacctggagggcaagcaggggaacttcaagaacctccgcgagttcgtgttcaagaacatcgacggctacttcaagatctactccaagcacaccccgatcaacctggtgcgggacctgccccaggggttcagcgccctcgagcccctggtcgacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtggactgcgccctggaccccctgagcgagaccaagtgcaccctcaagtccttcaccgtcgagaaggggatctaccagacgagcaacttccgggtgcagcccaccgagtccatcgtgcgcttcccgaacatcaccaacctgtgccccttcggcgaggtcttcaacgccacccggttcgccagcgtgtacgcctggaaccgcaagcggatctccaactgcgtcgcggactacagcgtgctgtacaactccgccagcttctccacgttcaagtgctacggcgtgagccccaccaagctcaacgacctgtgcttcaccaacgtctacgccgactccttcgtgatccgcggggacgaggtgcggcagatcgcccccggccagaccgggaagatcgccgactacaactacaagctgccggacgacttcacgggctgcgtcatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtggtcctgagcttcgagctcctgcacgcccccgccacggtgtgcggccccaagaagtccaccaacctggtgaagaacaagtgcgtcaacttcaacttcaacggcctcaccgggaccggcgtgctgaccgagagcaacaagaagttcctgccgttccagcagttcgggcgcgacatcgacgacacgaccgacgccgtgcgcgacccccagaccctggagatcctcgacatcaccccctgcagcttcggcggggtctccgtgatcacgccgggcaccaacaccagcaaccaggtggcggtcctgtaccagggcgtgaactgcaccgaggtgcccgtcgccatccacgccgaccagctgacgcccacctggcgggtgtactccaccgggagcaacgtgttccagacccgcgccggctgcctcatcggggccgagcacgtcaacaactcctacgagtgcgacatccccatcggcgcgggcatctgcgccagctaccagacgcagaccaactcccaccggcgcgcccggagcgtggcctcccagagcatcatcgcgtacaccatgtccctgggggccgagaacagcgtggcctactccaacaacagcatcgccatcccgatcaacttcaccatctccgtcacgaccgagatcctgcccgtgagcatgaccaagaccagcgtggactgcacgatgtacatctgcggcgactccaccgagtgcagcaacctcctgctgcagtacgggtccttctgcacccagctcaaccgcgccctgaccggcatcgcggtcgagcaggacaagaacacgcaggaggtgttcgcccaggtgaagcagatctacaagaccccgcccatcaaggacttcgggggcttcaacttcagccagatcctgcccgacccctccaagcccagcaagcggtccttcatcgaggacctcctgttcaacaaggtcaccctggccgacgccggcttcatcaagcagtacggggactgcctcggcgacatcgccgcgcgcgacctgatctgcgcccagaagttcaacgggctgaccgtgctgcccccgctcctgacggacgagatgatcgcccagtacaccagcgccctcctggccggcaccatcacctccgggtggacgttcggcgcgggcgccgccctgcagatccccttcgccatgcagatggcgtaccggttcaacgggatcggcgtgacccagaacgtcctctacgagaaccagaagctgatcgccaaccagttcaacagcgccatcgggaagatccaggactccctgagctccaccgccagcgccctcggcaagctgcaggacgtggtgaaccagaacgcgcaggccctgaacaccctcgtcaagcagctgtccagcaacttcggggccatctccagcgtgctgaacgacatcctcgcccgcctggacaaggtggaggccgaggtccagatcgaccggctgatcacgggccgcctccagtccctgcagacctacgtgacccagcagctgatccgggcggccgagatccgcgccagcgccaacctcgccgcgaccaagatgagcgagtgcgtgctgggccagtccaagcgggtcgacttctgcgggaagggctaccacctgatgagcttcccccagtccgcgccccacggggtggtgttcctccacgtcacctacgtgccggcccaggagaagaacttcacgaccgcccccgccatctgccacgacggcaaggcccacttcccccgcgagggggtcttcgtgagcaacggcacccactggttcgtgacccagcggaacttctacgagccccagatcatcacgacccacaacaccttcgtctccggcaactgcgacgtggtgatcgggatcgtcaacaacaccgtgtacgacccgctgcagcccgagctggacagcttcaaggaggagctcgacaagtacttcaagaaccacacgtcccccgacgtggacctgggcgacatcagcgggatcaacgcctccgtcgtgaacatccagaaggagatcgaccgcctgaacgaggtggccaagaacctcaacgagagcctgatcgacctgcaggagctcggcaagtacgagcagtacatcaagtggccctggtacatctggctgggcttcatcgccgggctgatcgcgatcgtcatggtgaccatcatgctctgctgcatgacctcctgctgcagctgcctgaagggctgctgctcctgcgggagctgctgcaagttcgacgaggacgactccgagccggtgctgaagggcgtcaagctccactacacctga

SEQ ID NO: 23000 - RNA, 3822 nt, synthetic construct
  misc_feature 1..3822: note = SARS-CoV-2/Wuhan/WIV05/2019__EPI_ISL_402128 spike protein CDS gc (1-1273)(K417N_E484K_N501Y_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 23001 - RNA, 3813 nt, synthetic construct
  misc_feature 1..3813: note = SARS-CoV-2/Wuhan/WIV05/2019__EPI_ISL_402128 spike protein CDS gc (1-1273)(L18F_D80A_D215G_L242del_A243del_L244del_R246I_K417 N_E484K_N501Y_D614G_A701V)
  source 1..3813: mol_type = other RNA
atgttcgtgttcctggtcctcctgcccctggtgagctcccagtgcgtgaacttcaccacccgcacgcagctcccgcccgcctacaccaacagcttcacccggggcgtctactaccccgacaaggtgttccgctccagcgtgctgcactccacccaggacctgttcctccccttcttcagcaacgtcacgtggttccacgccatccacgtgtccgggaccaacggcaccaagcggttcgcgaacccggtgctgcccttcaacgacggggtctacttcgccagcaccgagaagtccaacatcatccgcggctggatcttcgggacgaccctggacagcaagacccagtccctcctgatcgtgaacaacgccaccaacgtggtcatcaaggtgtgcgagttccagttctgcaacgaccccttcctgggcgtgtactaccacaagaacaacaagagctggatggagtccgagttccgggtctacagctccgccaacaactgcacgttcgagtacgtgagccagcccttcctcatggacctggagggcaagcaggggaacttcaagaacctgcgcgagttcgtgttcaagaacatcgacggctacttcaagatctactccaagcacaccccgatcaacctcgtccgggggctgccccagggcttcagcgccctggagcccctcgtggacctgcccatcgggatcaacatcacccgcttccagaccctgcacatctcctacctcacgccgggcgacagcagctccggctggaccgcgggggccgccgcctactacgtgggctacctgcagccccggaccttcctgctcaagtacaacgagaacgggaccatcacggacgcggtcgactgcgccctggaccccctgagcgagaccaagtgcaccctcaagtccttcaccgtggagaagggcatctaccagacgagcaacttccgcgtgcagcccaccgagtccatcgtccggttcccgaacatcaccaacctgtgccccttcggcgaggtgttcaacgccacccgcttcgccagcgtctacgcctggaaccggaagcgcatctccaactgcgtggcggactacagcgtgctgtacaactccgccagcttctccacgttcaagtgctacggggtcagccccaccaagctcaacgacctgtgcttcaccaacgtgtacgccgactccttcgtgatccggggcgacgaggtccgccagatcgcccccgggcagaccggcaacatcgccgactacaactacaagctgccggacgacttcacggggtgcgtgatcgcgtggaacagcaacaacctcgactccaaggtgggcggcaactacaactacctgtaccggctgttccgcaagagcaacctcaagcccttcgagcgggacatctccaccgagatctaccaggccgggagcaccccctgcaacggcgtcaaggggttcaactgctacttccccctgcagtcctacggcttccagccgacctacggggtgggctaccagccctaccgcgtggtcgtgctgagcttcgagctcctgcacgcccccgccacggtgtgcggccccaagaagtccaccaacctggtcaagaacaagtgcgtgaacttcaacttcaacgggctcaccggcaccggggtgctgaccgagagcaacaagaagttcctgccgttccagcagttcggccgggacatcgccgacacgaccgacgcggtccgcgacccccagaccctcgagatcctggacatcaccccctgcagcttcgggggcgtgtccgtgatcacgccgggcaccaacaccagcaaccaggtcgccgtgctgtaccagggggtgaactgcaccgaggtccccgtggccatccacgccgaccagctgacgcccacctggcgcgtgtactccaccggcagcaacgtcttccagacccgggccgggtgcctcatcggcgcggagcacgtgaacaactcctacgagtgcgacatccccatcggcgccgggatctgcgccagctaccagacgcagaccaactccccgcgccgggcccgcagcgtggcgtcccagagcatcatcgcctacaccatgtccctgggcgtcgagaacagcgtggcctactccaacaacagcatcgccatccccaccaacttcacgatctccgtgaccaccgagatcctgcccgtcagcatgaccaagacgagcgtggactgcaccatgtacatctgcggggactccaccgagtgcagcaacctcctgctgcagtacggctccttctgcacccagctcaaccgggccctgacggggatcgcggtggagcaggacaagaacacccaggaggtcttcgcccaggtgaagcagatctacaagacgcccccgatcaaggacttcggcggcttcaacttcagccagatcctgcccgacccctccaagcccagcaagcgctccttcatcgaggacctcctgttcaacaaggtgaccctggccgacgccgggttcatcaagcagtacggcgactgcctcggggacatcgccgcgcgggacctgatctgcgcccagaagttcaacggcctgaccgtcctcccgcccctgctgaccgacgagatgatcgcccagtacaccagcgccctcctggccgggaccatcacgtccggctggaccttcggcgcgggggccgccctgcagatccccttcgccatgcagatggcgtaccgcttcaacggcatcggggtgacccagaacgtgctctacgagaaccagaagctgatcgccaaccagttcaacagcgccatcggcaagatccaggactccctgagctccaccgccagcgccctcgggaagctgcaggacgtcgtgaaccagaacgcgcaggccctgaacacgctcgtgaagcagctgtccagcaacttcggcgccatctccagcgtcctgaacgacatcctctcccggctggacaaggtggaggccgaggtgcagatcgaccgcctgatcaccggccggctccagagcctgcagacctacgtcacccagcagctgatccgcgccgcggagatccgggccagcgccaacctcgccgccaccaagatgtccgagtgcgtgctggggcagagcaagcgcgtggacttctgcggcaaggggtaccacctgatgtccttcccccagagcgcgccgcacggcgtcgtgttcctccacgtcacgtacgtgcccgcccaggagaagaacttcaccaccgcccccgccatctgccacgacgggaaggcgcacttcccccgggagggcgtgttcgtctccaacggcacccactggttcgtgacgcagcgcaacttctacgagccgcagatcatcaccaccgacaacaccttcgtgagcgggaactgcgacgtcgtgatcggcatcgtgaacaacacggtctacgaccccctgcagcccgagctggactccttcaaggaggagctcgacaagtacttcaagaaccacaccagccccgacgtggacctgggggacatctccggcatcaacgccagcgtggtcaacatccagaaggagatcgaccggctgaacgaggtggccaagaacctcaacgagtccctgatcgacctgcaggagctcggcaagtacgagcagtacatcaagtggccgtggtacatctggctggggttcatcgccggcctgatcgccatcgtgatggtcaccatcatgctctgctgcatgaccagctgctgctcctgcctgaaggggtgctgcagctgcggctcctgctgcaagttcgacgaggacgacagcgagcccgtgctgaagggggtgaagctccactacacgtga

SEQ ID NO: 23002 - RNA, 3822 nt, synthetic construct
  misc_feature 1..3822: note = SARS-CoV-2/Wuhan/WIV05/2019__EPI_ISL_402128 spike protein CDS gc (1-1273)(E484K_D614G)
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccgggagcaacgtcttccagacccgcgccggctgcctcatcggggcggagcacgtgaacaactcctacgagtgcgacatccccatcggcgccggcatctgcgccagctaccagacgcagaccaactccccgcggcgcgcccggagcgtggcgtcccagagcatcatcgcctacaccatgtccctgggggccgagaacagcgtcgcctactccaacaacagcatcgccatccccaccaacttcacgatctccgtgaccaccgagatcctgcccgtgagcatgaccaagacgagcgtcgactgcaccatgtacatctgcggcgactccaccgagtgcagcaacctcctgctgcagtacgggtccttctgcacccagctcaaccgcgcgctgacgggcatcgccgtggagcaggacaagaacacccaggaggtgttcgcccaggtcaagcagatctacaagacgcccccgatcaaggacttcgggggcttcaacttcagccagatcctgcccgacccctccaagcccagcaagcggtccttcatcgaggacctcctgttcaacaaggtgaccctggccgacgccggcttcatcaagcagtacggggactgcctcggcgacatcgcggcccgcgacctgatctgcgcccagaagttcaacgggctgaccgtgctcccgcccctgctgaccgacgagatgatcgcccagtacaccagcgccctcctggcgggcaccatcacgtccgggtggaccttcggcgccggcgccgccctgcagatccccttcgcgatgcagatggcctaccggttcaacgggatcggcgtcacccagaacgtgctctacgagaaccagaagctgatcgccaaccagttcaacagcgccatcgggaagatccaggactccctgagctccaccgccagcgcgctcggcaagctgcaggacgtggtcaaccagaacgcccaggccctgaacacgctcgtgaagcagctgtccagcaacttcggggccatctccagcgtgctgaacgacatcctctcccgcctggacaaggtcgaggccgaggtgcagatcgaccggctgatcaccggccgcctccagagcctgcagacctacgtgacccagcagctgatccgggcggccgagatccgcgccagcgccaacctcgccgcgaccaagatgtccgagtgcgtcctgggccagagcaagcgggtggacttctgcgggaagggctaccacctgatgtccttcccccagagcgccccgcacggggtggtcttcctccacgtgacgtacgtccccgcccaggagaagaacttcaccaccgcccccgcgatctgccacgacggcaaggcccacttcccccgcgagggggtgttcgtgtccaacggcacccactggttcgtcacgcagcggaacttctacgagccgcagatcatcaccaccgacaacaccttcgtgagcggcaactgcgacgtggtcatcgggatcgtgaacaacacggtgtacgaccccctgcagcccgagctggactccttcaaggaggagctcgacaagtacttcaagaaccacaccagccccgacgtcgacctgggcgacatctccgggatcaacgccagcgtggtgaacatccagaaggagatcgaccgcctgaacgaggtcgccaagaacctcaacgagtccctgatcgacctgcaggagctcggcaagtacgagcagtacatcaagtggccgtggtacatctggctgggcttcatcgccgggctgatcgcgatcgtgatggtgaccatcatgctctgctgcatgaccagctgctgctcctgcctgaagggctgctgcagctgcgggtcctgctgcaagttcgacgaggacgacagcgagcccgtcctgaagggcgtgaagctccactacacgtga

SEQ ID NO: 23003 - RNA, 3822 nt, synthetic construct
  misc_feature 1..3822: note = SARS-CoV-2/Wuhan/WIV05/2019__EPI_ISL_402128 spike protein CDS gc (1-1273)(L18F_T20N_P26S_D138Y_R190S_K417T_E484K_N501Y_D614G _H655Y_T1027I)
  source 1..3822: mol_type = other RNA
atgttcgtgttcctggtcctcctgcccctggtgagctcccagtgcgtgaacttcaccaaccgcacccagctcccgagcgcctacacgaactccttcacccggggcgtctactaccccgacaaggtgttccgcagctccgtgctgcacagcacccaggacctgttcctccccttcttctccaacgtcacctggttccacgccatccacgtgagcgggacgaacggcaccaagcggttcgacaaccccgtgctgccgttcaacgacggggtctacttcgcgtccaccgagaagtccaacatcatccgcggctggatcttcgggaccacgctggactccaagacccagagcctcctgatcgtgaacaacgccaccaacgtggtcatcaaggtgtgcgagttccagttctgcaactaccccttcctgggcgtgtactaccacaagaacaacaagtcctggatggagagcgagttccgggtctactccagcgccaacaactgcaccttcgagtacgtgtcccagcccttcctcatggacctggagggcaagcaggggaacttcaagaacctgagcgagttcgtgttcaagaacatcgacggctacttcaagatctactccaagcacacgcccatcaacctcgtccgcgacctgccgcaggggttcagcgccctggagcccctcgtggacctgcccatcggcatcaacatcacccggttccagaccctgctcgccctgcaccgcagctacctgacccccggggactccagctccggctggacggcgggcgccgccgcctactacgtggggtacctccagccgcggaccttcctgctgaagtacaacgagaacggcaccatcaccgacgcggtcgactgcgccctcgaccccctgagcgagacgaagtgcaccctgaagtccttcaccgtggagaaggggatctaccagaccagcaacttccgcgtgcagcccacggagtccatcgtccggttccccaacatcaccaacctctgcccgttcggcgaggtgttcaacgccacccgcttcgccagcgtctacgcctggaaccggaagcgcatctccaactgcgtggcggactacagcgtgctgtacaactccgccagcttctccaccttcaagtgctacggcgtcagccccacgaagctgaacgacctctgcttcaccaacgtgtacgccgactccttcgtgatccgcggggacgaggtccggcagatcgcccccggccagaccgggaccatcgccgactacaactacaagctgcccgacgacttcacgggctgcgtgatcgcgtggaacagcaacaacctggactccaaggtcgggggcaactacaactacctctaccggctgttccgcaagagcaacctgaagccgttcgagcgggacatctccaccgagatctaccaggccggcagcaccccctgcaacggggtgaagggcttcaactgctacttccccctccagagctacgggttccagcccacctacggcgtggggtaccagccgtaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgcccttccagcagttcgggcgggacatcgccgacacgaccgacgcggtccgcgacccgcagaccctggagatcctggacatcaccccctgcagcttcggcggggtgtccgtgatcacgcccggcaccaacaccagcaaccaggtcgccgtgctctaccagggcgtgaactgcaccgaggtcccggtggccatccacgccgaccagctgacgcccacctggcgcgtgtactccaccgggagcaacgtcttccagacccgggccggctgcctgatcggggcggagtacgtgaacaactcctacgagtgcgacatccccatcggcgccggcatctgcgccagctaccagacgcagaccaacagcccccgccgggcccgcagcgtggcgtcccagagcatcatcgcctacaccatgtccctcggggccgagaacagcgtcgcctactccaacaacagcatcgccatcccgaccaacttcacgatcagcgtgaccaccgagatcctgcccgtgtccatgaccaagacgagcgtcgactgcaccatgtacatctgcggcgactccaccgagtgcagcaacctgctcctgcagtacgggtccttctgcacccagctgaaccgggcgctcacgggcatcgccgtggagcaggacaagaacacccaggaggtgttcgcccaggtcaagcagatctacaagaccccgcccatcaaggacttcgggggcttcaacttcagccagatcctgcccgacccctccaagcccagcaagcgctccttcatcgaggacctcctgttcaacaaggtgaccctggccgacgccggcttcatcaagcagtacggggactgcctgggcgacatcgcggcccgggacctcatctgcgcccagaagttcaacgggctgacggtgctgcccccgctcctgaccgacgagatgatcgcccagtacaccagcgccctgctcgcgggcaccatcacgtccgggtggaccttcggcgccggcgccgccctgcagatccccttcgcgatgcagatggcctaccgcttcaacgggatcggcgtcacccagaacgtgctgtacgagaaccagaagctcatcgccaaccagttcaacagcgccatcgggaagatccaggactccctgagctccaccgccagcgcgctgggcaagctccaggacgtggtcaaccagaacgcccaggccctgaacacgctggtgaagcagctctccagcaacttcggggccatctccagcgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgatcaagatgtccgagtgcgtcctcggccagagcaagcgcgtggacttctgcgggaagggctaccacctgatgtccttcccccagagcgcgccccacggggtggtcttcctgcacgtgacctacgtcccggcccaggagaagaacttcacgaccgcccccgccatctgccacgacggcaaggcccacttcccccgggagggggtgttcgtgtccaacggcacccactggttcgtcacccagcgcaacttctacgagccccagatcatcacgaccgacaacaccttcgtgagcggcaactgcgacgtggtcatcgggatcgtgaacaacaccgtgtacgacccgctccagcccgagctggactccttcaaggaggagctggacaagtacttcaagaaccacacgagccccgacgtcgacctcggcgacatctccgggatcaacgccagcgtggtgaacatccagaaggagatcgaccggctgaacgaggtcgccaagaacctgaacgagtccctcatcgacctgcaggagctgggcaagtacgagcagtacatcaagtggccctggtacatctggctcggcttcatcgccgggctgatcgcgatcgtgatggtgaccatcatgctgtgctgcatgaccagctgctgctcctgcctcaagggctgctgcagctgcgggtcctgctgcaagttcgacgaggacgacagcgagccggtcctgaagggcgtgaagctgcactacacctga

SEQ ID NO: 23004 - RNA, 3822 nt, synthetic construct
  misc_feature 1..3822: note = SARS-CoV-2/Wuhan/WIV05/2019__EPI_ISL_402128 spike protein CDS gc (1-1273)(S13I_W152C_L452R_D614G)
  source 1..3822: mol_type = other RNA
atgttcgtgttcctggtcctcctgcccctggtgagcatccagtgcgtgaacctcaccacccgcacgcagctgccgcccgcctacaccaactccttcacccggggcgtctactaccccgacaaggtgttccgcagctccgtgctgcacagcacccaggacctcttcctgcccttcttctccaacgtcacgtggttccacgccatccacgtgagcgggaccaacggcaccaagcggttcgacaacccggtgctgcccttcaacgacggggtctacttcgcgtccaccgagaagtccaacatcatccgcggctggatcttcgggacgaccctcgacagcaagacccagagcctgctgatcgtgaacaacgccaccaacgtggtcatcaaggtgtgcgagttccagttctgcaacgaccccttcctcggcgtgtactaccacaagaacaacaagtcctgcatggagagcgagttccgggtctactccagcgccaacaactgcacgttcgagtacgtgtcccagcccttcctgatggacctggagggcaagcaggggaacttcaagaacctccgcgagttcgtgttcaagaacatcgacggctacttcaagatctacagcaagcacaccccgatcaacctggtccgggacctgccccaggggttctccgccctcgagcccctggtggacctgcccatcggcatcaacatcacccgcttccagaccctcctggccctgcaccggagctacctcacgccgggggactccagcagcggctggaccgcgggcgccgccgcctactacgtggggtacctgcagccccgcaccttcctgctcaagtacaacgagaacggcaccatcacggacgcggtcgactgcgccctggaccccctgtccgagaccaagtgcaccctcaagagcttcaccgtggagaaggggatctaccagacgtccaacttccgggtgcagcccaccgagagcatcgtccgcttcccgaacatcaccaacctgtgccccttcggcgaggtgttcaacgccacccggttcgcctccgtctacgcctggaaccgcaagcggatcagcaactgcgtggcggactactccgtgctgtacaacagcgcctccttcagcacgttcaagtgctacggcgtctcccccaccaagctcaacgacctgtgcttcaccaacgtgtacgccgacagcttcgtgatccgcggggacgaggtccggcagatcgcccccggccagaccgggaagatcgccgactacaactacaagctgccggacgacttcacgggctgcgtgatcgcgtggaactccaacaacctcgacagcaaggtcgggggcaactacaactaccgctaccggctgttccgcaagtccaacctgaagcccttcgagcgggacatcagcaccgagatctaccaggccggctccaccccctgcaacggggtggagggcttcaactgctacttccccctccagagctacgggttccagccgaccaacggcgtggggtaccagccctaccgcgtggtcgtgctgtccttcgagctgctccacgcccccgccacggtgtgcggccccaagaagtccaccaacctggtcaagaacaagtgcgtgaacttcaacttcaacggcctgaccgggaccggcgtgctcaccgagagcaacaagaagttcctgccgttccagcagttcgggcgcgacatcgccgacacgaccgacgcggtccgggacccccagaccctggagatcctggacatcaccccctgcagcttcggcggggtgagcgtgatcacgccgggcaccaacacctccaaccaggtcgccgtgctctaccagggcgtgaactgcaccgaggtccccgtggccatccacgccgaccagctgacgcccacctggcgcgtgtacagcaccgggtccaacgtcttccagacccgggccggctgcctgatcggggcggagcacgtgaacaacagctacgagtgcgacatccccatcggcgccggcatctgcgcctcctaccagacgcagaccaacagcccgcgccgggcccgctccgtggcgagccagtccatcatcgcctacaccatgagcctcggggccgagaactccgtcgcctacagcaacaactccatcgccatccccaccaacttcacgatcagcgtgaccaccgagatcctgcccgtgtccatgaccaagacgagcgtcgactgcaccatgtacatctgcggcgacagcaccgagtgctccaacctgctcctgcagtacgggagcttctgcacccagctgaaccgggcgctcacgggcatcgccgtggagcaggacaagaacacccaggaggtgttcgcccaggtcaagcagatctacaagacgcccccgatcaaggacttcgggggcttcaacttctcccagatcctgcccgaccccagcaagccctccaagcgcagcttcatcgaggacctcctgttcaacaaggtgaccctggccgacgccggcttcatcaagcagtacggggactgcctgggcgacatcgcggcccgggacctcatctgcgcccagaagttcaacgggctgaccgtgctgccgcccctcctgaccgacgagatgatcgcccagtacacctccgccctgctcgcgggcaccatcacgagcgggtggaccttcggcgccggcgccgccctgcagatccccttcgcgatgcagatggcctaccgcttcaacgggatcggcgtcacccagaacgtgctgtacgagaaccagaagctcatcgccaaccagttcaactccgccatcgggaagatccaggacagcctgtccagcaccgcctccgcgctgggcaagctccaggacgtggtcaaccagaacgcccaggccctgaacacgctggtgaagcagctcagctccaacttcggggccatcagctccgtgctgaacgacatcctgagccggctcgacaaggtcgaggccgaggtgcagatcgaccgcctgatcaccggccggctgcagtccctccagacctacgtgacccagcagctgatccgcgcggccgagatccgggccagcgccaacctggccgcgaccaagatgagcgagtgcgtcctcggccagtccaagcgcgtggacttctgcgggaagggctaccacctgatgagcttcccccagtccgccccgcacggggtggtcttcctgcacgtgacgtacgtccccgcccaggagaagaacttcaccaccgcccccgcgatctgccacgacggcaaggcccacttcccccgggagggggtgttcgtgagcaacggcacccactggttcgtcacgcagcgcaacttctacgagccgcagatcatcaccaccgacaacaccttcgtgtccggcaactgcgacgtggtcatcgggatcgtgaacaacacggtgtacgaccccctccagcccgagctggacagcttcaaggaggagctggacaagtacttcaagaaccacacctcccccgacgtcgacctcggcgacatcagcgggatcaacgcctccgtggtgaacatccagaaggagatcgaccggctgaacgaggtcgccaagaacctgaacgagagcctcatcgacctgcaggagctgggcaagtacgagcagtacatcaagtggccgtggtacatctggctcggcttcatcgccgggctgatcgcgatcgtgatggtgaccatcatgctgtgctgcatgacctcctgctgcagctgcctcaagggctgctgctcctgcgggagctgctgcaagttcgacgaggacgactccgagcccgtcctgaagggcgtgaagctgcactacacgtga

SEQ ID NO: 23005 - RNA, 3822 nt, synthetic construct
  misc_feature 1..3822: note = SARS-CoV-2/Wuhan/WIV05/2019__EPI_ISL_402128 spike protein CDS gc (1-1273)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23006 - RNA, 3822 nt, synthetic construct
  misc_feature 1..3822: note = SARS-CoV-2/Wuhan/WIV05/2019__EPI_ISL_402128 spike protein CDS gc (1-1273)(D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23007 - RNA, 3822 nt, synthetic construct
  misc_feature 1..3822: note = SARS-CoV-2/Wuhan/WIV05/2019__EPI_ISL_402128 spike protein CDS gc (1-1273)(A222V_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23008 - RNA, 3822 nt, synthetic construct
  misc_feature 1..3822: note = SARS-CoV-2/Wuhan/WIV05/2019__EPI_ISL_402128 spike protein CDS gc (1-1273)(N439K_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaagaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23009 - RNA, 3822 nt, synthetic construct
  misc_feature 1..3822: note = SARS-CoV-2/Wuhan/WIV05/2019__EPI_ISL_402128 spike protein CDS gc (1-1273)(S477N_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23010 - RNA, 3822 nt, synthetic construct
  misc_feature 1..3822: note = SARS-CoV-2/Wuhan/WIV05/2019__EPI_ISL_402128 spike protein CDS gc (1-1273)(N501Y_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23011 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_D614G)
  source 1..3816: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23012 - RNA, 3822 nt, synthetic construct
  misc_feature 1..3822: note = SARS-CoV-2/Wuhan/WIV05/2019__EPI_ISL_402128 spike protein CDS gc (1-1273)(Y453F_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23013 - RNA, 3822 nt, synthetic construct
  misc_feature 1..3822: note = SARS-CoV-2/Wuhan/WIV05/2019__EPI_ISL_402128 spike protein CDS gc (1-1273)(D614G_I692V)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23014 - RNA, 3822 nt, synthetic construct
  misc_feature 1..3822: note = SARS-CoV-2/Wuhan/WIV05/2019__EPI_ISL_402128 spike protein CDS gc (1-1273)(D614G_M1229I)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23015 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_A222V_Y453F_S477N_D614G_I692V)
  source 1..3816: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagtgctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggcaacaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23016 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_Y453F_D614G_I692V_M1229I)
  source 1..3816: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgttccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcgtgatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23017 - RNA, 3813 nt, synthetic construct
  misc_feature 1..3813: note = SARS-CoV-2/Wuhan/WIV05/2019__EPI_ISL_402128 spike protein CDS gc (1-1273)(H69del_V70del_Y144del_N501Y_A570D_D614G_P681H_T716 I_S982A_D1118H)
  source 1..3813: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgacgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcacaccggagggcaaggagcgtggccagccagagcatcatcgcctacaccatgagcctgggcgccgagaacagcgtggcctacagcaacaacagcatcgccatccccatcaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctggcccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23018 - RNA, 3822 nt, synthetic construct
  misc_feature 1..3822: note = SARS-CoV-2/Wuhan/WIV05/2019__EPI_ISL_402128 spike protein CDS gc (1-1273)(K417N_E484K_N501Y_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23019 - RNA, 3813 nt, synthetic construct
  misc_feature 1..3813: note = SARS-CoV-2/Wuhan/WIV05/2019__EPI_ISL_402128 spike protein CDS gc (1-1273)(L18F_D80A_D215G_L242del_A243del_L244del_R246I_K417 N_E484K_N501Y_D614G_A701V)
  source 1..3813: mol_type = other RNA
atgttcgtgttcctggtgctgctgcccctggtgagcagccagtgcgtgaacttcaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23020 - RNA, 3822 nt, synthetic construct
  misc_feature 1..3822: note = SARS-CoV-2/Wuhan/WIV05/2019__EPI_ISL_402128 spike protein CDS gc (1-1273)(E484K_D614G)
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23021 - RNA, 3822 nt, synthetic construct
  misc_feature 1..3822: note = SARS-CoV-2/Wuhan/WIV05/2019__EPI_ISL_402128 spike protein CDS gc (1-1273)(L18F_T20N_P26S_D138Y_R190S_K417T_E484K_N501Y_D614G _H655Y_T1027I)
  source 1..3822: mol_type = other RNA
atgttcgtgttcctggtgctgctgcccctggtgagcagccagtgcgtgaacttcaccaaccggacccagctgccaagcgcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaactaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgagcgagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaccatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccatcaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23022 - RNA, 3822 nt, synthetic construct
  misc_feature 1..3822: note = SARS-CoV-2/Wuhan/WIV05/2019__EPI_ISL_402128 spike protein CDS gc (1-1273)(S13I_W152C_L452R_D614G)
  source 1..3822: mol_type = other RNA
atgttcgtgttcctggtgctgctgcccctggtgagcatccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctgcatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactaccgctaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggacaaggtcgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 23023 - RNA, 3822 nt, synthetic construct
  misc_feature 1..3822: note = SARS-CoV-2/Wuhan/WIV05/2019__EPI_ISL_402128 spike protein CDS gc (1-1273)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccaggacgtgaactgcaccgaggtgcccgtggccatccacgccgaccagctgacccccacctggcgggtgtacagcaccggaagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgattgcctgggcgacatcgccgctcgggacctgatctgcgcccagaagttcaacgggctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggcgtgttcgtgagcaacggaacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgatgtggacctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23024 - RNA, 3822 nt, synthetic construct
  misc_feature 1..3822: note = SARS-CoV-2/Wuhan/WIV05/2019__EPI_ISL_402128 spike protein CDS gc (1-1273)(D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23025 - RNA, 3822 nt, synthetic construct
  misc_feature 1..3822: note = SARS-CoV-2/Wuhan/WIV05/2019__EPI_ISL_402128 spike protein CDS gc (1-1273)(A222V_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtcagcgtgatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagcccccggcgggcccggagcgtggccagccagagcatcatcgcctacaccatgagcttaggcgccgagaacagcgtggcctacagcaacaacagcatcgccatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatttgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23026 - RNA, 3822 nt, synthetic construct
  misc_feature 1..3822: note = SARS-CoV-2/Wuhan/WIV05/2019__EPI_ISL_402128 spike protein CDS gc (1-1273)(N439K_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaagaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23027 - RNA, 3822 nt, synthetic construct
  misc_feature 1..3822: note = SARS-CoV-2/Wuhan/WIV05/2019__EPI_ISL_402128 spike protein CDS gc (1-1273)(S477N_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcaacaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgcgcctcctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaatttcggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23028 - RNA, 3822 nt, synthetic construct
  misc_feature 1..3822: note = SARS-CoV-2/Wuhan/WIV05/2019__EPI_ISL_402128 spike protein CDS gc (1-1273)(N501Y_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaacgacatcctgagcaggctggacaaggtggaggccgaggtgcagatcgaccggctgatcaccggccggctgcagagcctgcagacctacgtgacccagcagctgatccgggccgccgagatccgggccagcgccaatctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23029 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_D614G)
  source 1..3816: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtgacatacgtccccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23030 - RNA, 3822 nt, synthetic construct
  misc_feature 1..3822: note = SARS-CoV-2/Wuhan/WIV05/2019__EPI_ISL_402128 spike protein CDS gc (1-1273)(Y453F_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23031 - RNA, 3822 nt, synthetic construct
  misc_feature 1..3822: note = SARS-CoV-2/Wuhan/WIV05/2019__EPI_ISL_402128 spike protein CDS gc (1-1273)(D614G_I692V)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtcttcctccacgtgacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23032 - RNA, 3822 nt, synthetic construct
  misc_feature 1..3822: note = SARS-CoV-2/Wuhan/WIV05/2019__EPI_ISL_402128 spike protein CDS gc (1-1273)(D614G_M1229I)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23033 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_A222V_Y453F_S477N_D614G_I692V)
  source 1..3816: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgtgctggagcctctggtggacctgcccatcggcatcaacatcaccaggttccagaccctgctggccctgcaccggagctacctgacccccggcgacagcagcagcggctggaccgccggcgccgccgcctactacgtgggctacctgcagccacggaccttcctgctgaagtacaacgagaacggcaccatcaccgacgcagtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgccgacagcttcgtgatccggggcgacgaggtgcggcagatcgctcccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcaacaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaatttcaacttcaacggcctgaccggcaccggcgtgctgaccgagagcaacaagaagttcctgcccttccagcagttcggccgggatatcgccgacaccaccgacgccgtgcgggacccccagaccctggagatcctggacatcaccccatgcagcttcggcggcgtgagcgtcatcacccccggcacaaacaccagcaaccaggtggcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgccggcatctgcgcttcctaccagacccagaccaacagcccccggcgggcccggagcgtggccagccagagcgtgatcgcctacaccatgagcttaggcgccgagaacagcgtggcctacagcaacaacagcatcgccatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgcccgggacctgatctgcgctcagaagttcaacggcctgaccgtgctgccccctctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaattttggcgccatcagcagcgtgctgaacgacatcctgtcaaggctggacaaggtggaggccgaggtgcagatcgaccggctgatcaccggccggctgcagagcctgcagacctacgtgacccagcagctgatccgggccgccgagatccgggccagcgccaacctggccgcaaccaagatgagcgagtgcgtgctgggccagagcaagcgggtggacttctgcggcaagggctaccacctgatgagcttcccccagagcgccccacacggcgtggtcttcctccacgtgacatacgtgcccgcccaggagaagaacttcaccaccgcccccgccatctgccacgacggcaaggcccacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgctagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23034 - RNA, 3816 nt, synthetic construct
  misc_feature 1..3816: note = SARS-CoV-2/Wuhan/WIV05/2019__EPI_ISL_402128 spike protein CDS gc (1-1273)(H69del_V70del_Y453F_D614G_I692V_M1229I)
  source 1..3816: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgttccggctgttccgtaagagcaacctgaagccatttgagcgggacatcagcaccgagatctaccaggccggcagcaccccctgcaacggtgtggagggcttcaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtgatcacccccggcacaaacaccagcaaccaggtcgccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcgtgatcgcctacaccatgagcttaggcgccgagaacagcgtggcctacagcaacaacagcatcgcgatccctaccaacttcaccatcagcgtgaccaccgagatcctgcccgtgagcatgaccaagaccagcgtggactgtaccatgtacatatgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaactttggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttctgcggcaagggctaccacctgatgagcttcccccagagcgccccacacggcgtggtgttcctccacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagattatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatcgtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23035 - RNA, 3813 nt, synthetic construct
  misc_feature 1..3813: note = SARS-CoV-2/Wuhan/WIV05/2019__EPI_ISL_402128 spike protein CDS gc (1-1273)(H69del_V70del_Y144del_N501Y_A570D_D614G_P681H_T716 I_S982A_D1118H)
  source 1..3813: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatcagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtaccacaagaacaacaagagctggatggagagcgagttccgggtgtacagcagcgctaacaattgcaccttcgagtacgtcagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtggagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaacttcaatggcctgaccggcaccggcgtgctgaccgagagcaacaagaagttcctgcccttccagcagttcggccgggatatcgacgacaccaccgacgccgtgcgggacccccagaccctggagatcctggacatcaccccatgcagcttcggcggcgtgagcgtgatcacccccggcacaaacaccagcaaccaggtcgcagtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgccggcatctgcgctagctaccagacccagaccaacagccaccggcgggcccggagcgtggccagccagagcatcatcgcctacaccatgagcttaggcgccgagaacagcgtggcctacagcaacaacagcatcgccatccccatcaacttcaccataagcgtgaccaccgagatcctgcctgtgagcatgaccaagaccagcgtggactgtaccatgtacatctgcggcgacagcaccgagtgcagcaacctgctgctgcagtacggcagcttctgcacccagctgaaccgggcgctgaccggcatcgccgtggagcaggacaagaacacccaagaggtgttcgcccaggtgaagcagatctacaagaccccacccatcaaggacttcggcggcttcaacttcagccagatcctgcccgaccccagcaagcccagcaagcggagcttcatcgaggacctgctgttcaacaaggtgactctggccgacgccggcttcatcaagcagtacggcgattgcctgggggacatcgccgcccgggacctgatctgcgctcagaagttcaacggcctgaccgtgctgcctcccctgctgaccgacgagatgatcgcccagtacaccagcgccctgcttgccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaacttcggcgccatcagctcagtgctgaacgacatcctggccaggctggacaaggtggaggccgaggtgcagatcgaccggctgatcaccggccggctgcagagcctgcagacctacgtgacccagcagctgatccgggccgccgagattcgggccagcgccaatctggcagccaccaagatgagcgagtgcgtgctgggccagagcaagcgggtggacttttgcggcaagggctaccacctgatgagcttcccccagagcgctccccacggcgtggtgttcctccacgtgacctacgtcccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccacccacaacaccttcgtgagcggcaactgcgacgtggtgatcggcatcgtgaacaacaccgtgtacgaccccctgcagcccgagctggacagcttcaaggaggagctggacaagtacttcaagaaccacaccagccctgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23036 - RNA, 3822 nt, synthetic construct
  misc_feature 1..3822: note = SARS-CoV-2/Wuhan/WIV05/2019__EPI_ISL_402128 spike protein CDS gc (1-1273)(K417N_E484K_N501Y_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23037 - RNA, 3813 nt, synthetic construct
  misc_feature 1..3813: note = SARS-CoV-2/Wuhan/WIV05/2019__EPI_ISL_402128 spike protein CDS gc (1-1273)(L18F_D80A_D215G_L242del_A243del_L244del_R246I_K417 N_E484K_N501Y_D614G_A701V)
  source 1..3813: mol_type = other RNA
atgttcgtgttcctggtgctgctgcccctggtgagcagccagtgcgtgaacttcaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgccaacccagtgctgcccttcaacgacggcgtgtacttcgccagcaccgagaagtcaaacatcatccggggctggatctttggcaccaccctggacagcaagacacagagcctgctgatcgtgaacaacgctaccaacgtggtgatcaaggtgtgcgagttccagttctgcaacgaccccttcctgggcgtgtactaccacaagaacaacaagagctggatggagagcgagttccgggtctacagcagcgccaacaattgcaccttcgagtacgtgagccagcccttcctgatggacctggagggcaagcagggcaacttcaagaacctccgggagttcgtgttcaagaacatcgacggctacttcaagatctacagcaagcacacccccatcaacctggtgcggggactgccccagggcttcagcgccctggagcctctggtggatctgcccatcggcatcaacatcaccaggttccagaccctgcacatcagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcacccttaagagcttcaccgtggagaagggcatctaccagaccagcaacttccgggtgcagcccactgagagcattgtgcggttccccaacatcaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaacatcgccgactacaactacaagctgcccgacgacttcaccggctgcgtgatcgcctggaacagcaacaacctggacagcaaggtgggcggcaactacaactacctgtaccggctattccgtaagagcaacctgaagccatttgagcgggacatcagcaccgagatctaccaggccggtagcaccccctgcaacggcgtgaagggcttcaactgctacttccccctgcagagctacggcttccagcccacctacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggacatcgccgacaccaccgatgcagtgcgggacccccagaccctggagatcctggacatcaccccatgcagcttcggcggcgtgagcgtcatcacccccggaacaaacaccagcaaccaggtggccgtgctgtaccagggcgtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcctgggcgtggagaacagcgtggcctacagcaacaacagcatcgccatccctaccaacttcaccataagcgtgaccaccgagatcctgcccgtgagcatgaccaagaccagcgtggactgtaccatgtacatctgcggcgacagcaccgagtgcagcaacctgttactgcagtacggcagcttctgcacccagctgaaccgggcgctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggggactgcctgggcgacatcgccgcccgggacctgatctgcgctcagaagttcaacggcctgaccgtgctgccccctctgctgaccgatgagatgatcgcccagtacaccagcgccctgctggccggcaccatcaccagcggctggaccttcggcgccggcgccgcactgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgcccaggctctgaacaccctggtgaagcagctgagcagcaactttggcgccatcagctcagtgctgaatgacatcctgagccggctggacaaggtggaggccgaggtgcagatcgacaggctgatcaccggccggctgcagagcctgcagacctacgtgacccagcagctgatccgggccgccgagattcgggccagcgccaacctggccgcaaccaagatgagcgagtgcgtgctgggccagagcaagcgggtggacttctgcggcaagggctaccacctgatgagcttcccccagagcgccccacacggcgtggtcttcctgcacgtgacatacgtgcccgcccaggagaagaacttcaccaccgcccccgccatctgccacgacggaaaggcccacttcccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctcgacaagtacttcaagaaccacaccagccccgacgtggacctgggcgacatcagcggcatcaacgctagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23038 - RNA, 3822 nt, synthetic construct
  misc_feature 1..3822: note = SARS-CoV-2/Wuhan/WIV05/2019__EPI_ISL_402128 spike protein CDS gc (1-1273)(E484K_D614G)
  source 1..3822: mol_type = other RNA
atgttcgtgttcctggtgctgctgcccctggtgagcagccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctggatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgcaccctaaagagcttcaccgtggagaagggcatctaccagaccagcaacttccgggtgcagcccactgagagcatcgtgcggttccccaacattaccaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactacctgtaccggctgttccgtaagagcaacctgaagccattcgagcgggacatcagcaccgagatctaccaggccggcagcaccccctgcaacggtgtgaagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaactcctacgagtgcgacatccccatcggcgctggcatctgcgccagctaccagacccagaccaacagcccccggcgggcccggagcgtggccagccagagcatcatcgcctacaccatgagcttaggcgccgagaacagcgtggcctacagcaacaacagcatcgcgatccctaccaacttcaccatcagcgtgaccaccgagatactgcccgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgcttgccggcaccatcaccagcggctggaccttcggcgccggcgcagccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagctcagtgctgaatgacatcctgagcaggctggacaaggtggaggccgaggtgcagatcgaccggctgatcaccggccggctgcagagcctgcagacctacgtgacccagcagctgatccgggccgccgagatccgggccagcgccaacctggcagccaccaagatgagcgagtgcgtgctgggccagagcaagcgggtggacttttgcggcaagggctaccacctgatgagcttcccccagagcgccccacacggcgtggtgttcctccacgtcacatacgtgcccgcccaggagaagaacttcaccaccgcccccgccatttgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctgcagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagccagtgctgaagggcgtgaagctgcactacacctga

SEQ ID NO: 23039 - RNA, 3822 nt, synthetic construct
  misc_feature 1..3822: note = SARS-CoV-2/Wuhan/WIV05/2019__EPI_ISL_402128 spike protein CDS gc (1-1273)(L18F_T20N_P26S_D138Y_R190S_K417T_E484K_N501Y_D614G _H655Y_T1027I)
  source 1..3822: mol_type = other RNA
atgttcgtgttcctggtgctgctgcccctggtgagcagccagtgcgtgaacttcaccaaccggacccagctgcccagcgcctacaccaacagcttcacccggggcgtgtactaccctgacaaggtgttccggagcagcgtgctgcacagcacccaggacctgttcctgcccttcttcagcaacgtgacctggttccacgccatccacgtgagcggcaccaacggcaccaagcggttcgacaaccccgtgctgccattcaacgacggcgtgtacttcgccagcaccgagaagtcaaacatcatccggggctggatctttggcaccaccctggacagcaagacccagagcctgctgatcgtgaacaacgccacaaacgtggtgatcaaggtgtgcgagttccagttctgcaactaccccttcctgggcgtgtactaccacaagaacaacaagagctggatggagagcgagttccgggtctacagcagcgctaataactgcaccttcgagtacgtgagccagcccttcctgatggacctggagggcaagcagggcaacttcaagaacctcagcgagttcgtgttcaagaacatcgacggctacttcaagatctacagcaagcacacccccatcaacctggtgcgggatctgccccagggattcagcgccctggagcccctggtggacctgcctatcggcatcaacatcacccggttccagaccctgctggccctgcacaggagctacctgacccccggcgacagcagcagcggctggaccgccggcgccgccgcatactacgtgggctacctgcagccccggaccttcctgctgaagtacaacgagaacggcaccatcaccgacgccgtggactgcgccctggacccactgagcgagaccaagtgcaccctaaagagcttcaccgtggagaagggcatctaccagaccagcaacttccgggtgcagcccaccgagagcatcgtgcggttccccaacattactaacctgtgtcccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgctgacagcttcgtgatccggggcgacgaggtgcggcagatcgcccctggccagaccggcaccatcgccgactacaactacaagctgcccgacgacttcaccggctgcgtgatcgcctggaacagcaacaacctggacagcaaggtgggcggcaactacaactacctgtaccggctgttccgtaagagcaacctgaagccctttgagcgggacatcagcaccgagatctaccaggccggcagcaccccatgcaacggtgtgaagggcttcaactgctacttccccctgcagagctacggcttccagcccacctacggcgtgggctaccagccctaccgggtggtggtgctgagcttcgagctgctgcacgcccccgccaccgtgtgcggccccaaaaagagcaccaacctggtgaagaacaagtgcgtgaacttcaatttcaacggcctgaccggcaccggcgtgctgaccgagagcaacaagaagttcctgcctttccagcagttcggccgggacatcgccgataccaccgacgcagtgcgggacccccagaccctggagatcctggacatcaccccctgcagcttcggcggcgtgagcgtcatcaccccaggcacaaacaccagcaaccaggtggccgtgctgtaccagggagtgaactgcaccgaggtgcccgtggccatccacgccgaccagctgacccccacctggcgggtgtactccaccggcagcaacgtgttccagacccgggccggctgcctgatcggcgccgagtacgtgaacaacagctacgagtgcgacatccccatcggcgctggcatctgcgccagctaccagacccagaccaacagcccccggcgggcccggagcgtggccagccagagcatcatcgcctacaccatgagcctgggcgccgagaacagcgtggcctacagcaacaacagcatcgcgatccccaccaacttcaccatcagcgtgaccaccgagatattacctgtgagcatgaccaagaccagcgtggactgtaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactccacccatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggacatcgccgctcgggatctgatctgcgcccagaagttcaacggcctgaccgtgctgcctcccctgctgaccgacgagatgatcgcccagtacaccagcgccctgctggccggcaccatcaccagcggctggaccttcggcgccggcgcagcccttcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagctcaaactttggcgccatcagcagcgtgctgaatgacatcctgagccggctggacaaggtggaggccgaggtgcagatcgacaggctgatcaccggccggctgcagagcctgcagacctacgtgacccagcagctgatccgggccgccgagatccgggccagcgccaacctggcagccattaagatgagcgagtgcgtgctgggccagagcaagcgggtggacttctgcggcaagggctaccacctgatgagcttcccccagagcgctccccacggcgtggtgttcctgcacgtcacctacgtgccagcccaggagaagaacttcacaaccgcccccgccatctgccacgacggcaaggcccacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcccgagctggacagcttcaaggaggagctggacaagtacttcaagaaccacaccagccctgacgtggacctgggcgatatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgtagctgcctgaagggctgctgcagctgcggcagctgctgcaagttcgacgaggacgacagcgagcccgtgctgaagggcgtgaagctgcactacacctga

SEQ ID NO: 23040 - RNA, 3822 nt, synthetic construct
  misc_feature 1..3822: note = SARS-CoV-2/Wuhan/WIV05/2019__EPI_ISL_402128 spike protein CDS gc (1-1273)(S13I_W152C_L452R_D614G)
  source 1..3822: mol_type = other RNA
atgttcgtgttcctggtgctgctgcccctggtgagcatccagtgcgtgaacctgaccacccggacccagctgccccctgcctacaccaacagcttcacccggggcgtgtactaccccgacaaggtgttccggagcagcgtgctgcacagcacccaggacctgttcctgcccttcttcagcaacgtgacctggttccacgccatccacgtgagcggcaccaacggcaccaagcggttcgacaacccagtgctgcccttcaacgacggcgtgtacttcgccagcaccgagaagtcaaacatcatccggggctggatcttcggcaccaccctggacagcaagacacagagcctgctgatcgtgaacaacgccaccaacgtggtgatcaaggtgtgcgagtttcagttctgcaacgaccccttcctgggcgtgtactaccacaagaacaacaagagctgcatggagagcgagttccgggtctacagcagcgctaacaattgcaccttcgagtacgtgagccagcccttcctgatggacctcgagggcaagcagggcaacttcaagaacctgcgggagttcgtgttcaagaacatcgatggctacttcaagatctacagcaagcacacccccatcaacctggtgcgggacctgccccagggattcagcgccctggagcctctggtggacctgcccatcggcatcaacatcaccaggttccagaccctgctggccctgcaccggagctacctgacccccggcgacagcagcagcggctggaccgccggcgccgccgcatactacgtgggctacctgcagccacggaccttcctgctgaagtacaacgagaacggcaccatcaccgacgccgtggactgcgccctggaccccctgagcgagaccaagtgtaccctaaagagcttcaccgtggagaagggcatctaccagaccagcaacttccgggtgcagcccactgagagcattgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccctaccaagctgaacgacctgtgcttcaccaacgtgtacgctgacagcttcgtgatccggggcgacgaggtgcggcagatcgcccccggccagaccggcaagatcgccgactacaactacaagctgcccgacgacttcaccggctgcgtgatcgcctggaacagcaacaacctggacagcaaggtgggcggcaactacaactaccggtaccggctgttccgtaagagcaacctgaagccattcgagcgggacatcagcaccgagatctaccaggccggcagcaccccctgcaacggtgtggagggctttaactgctacttccccctgcagagctacggcttccagcccaccaacggcgtgggctaccagccctaccgggtggtggtgctgagcttcgagctgctgcacgcccccgccaccgtgtgcggccctaaaaagagcaccaacctggtgaagaacaagtgcgtgaacttcaatttcaacggcctgaccggcaccggcgtgctgaccgagagcaacaagaagttcctgcccttccagcagttcggccgggatatcgccgacaccaccgacgcagtgcgggacccccagaccctggagatcctggacatcaccccatgcagcttcggcggcgtgagcgtcatcacccccggcacaaacaccagcaaccaggtggccgtgctgtaccagggagtgaactgcaccgaggtgcccgtggccatccacgccgaccagctgacccccacctggcgggtgtacagcaccggcagcaacgtgttccagacccgggccggctgcctgatcggcgccgagcacgtgaacaacagctacgagtgcgacatccccatcggcgctggcatctgtgcctcctaccagacccagaccaacagcccccggcgggcccggagcgtggccagccagagcatcatcgcctacaccatgagcctgggcgccgagaacagcgtggcctacagcaacaacagcatcgcgatccctaccaacttcaccataagcgtgaccaccgagatcttacccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaagaggtgttcgcccaggtgaagcagatctacaagactcccccaatcaaggacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggggatatcgccgctcgggacctgatctgcgcccagaagttcaacggcctgaccgtgctgccccctctgctgaccgacgagatgatcgcccagtacaccagcgccctgctggccggcaccatcaccagcggctggaccttcggcgccggcgcagcccttcagatccccttcgccatgcagatggcctacaggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccagaacgctcaggccctgaacaccctggtgaagcagctgagcagcaacttcggcgccatcagcagcgtgctgaatgacatcctgtcacggctggacaaggtggaggccgaggtgcagatcgaccggctgatcaccggccggctgcagagcctgcagacctacgtgacccagcagctgatccgggccgccgagattcgggccagcgccaacctggcagccaccaagatgagcgagtgcgtgctgggccagagcaagcgggtggacttttgcggcaagggctaccacctgatgagcttcccccagagcgccccacacggcgtggtgttcctgcacgtcacatacgtgcccgcccaggagaagaacttcaccaccgcccccgccatctgccacgacggcaaggctcacttcccccgggagggagtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgaccccctccagcctgagctggacagcttcaaggaggagctggacaagtacttcaagaaccacaccagccccgacgtggatctgggcgacatcagcggcatcaacgccagcgtggtgaacatccagaaggagatcgaccggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgttgcagctgcctgaagggctgctgcagctgcggcagctgctgcaagttcgacgaggacgacagcgagccagtgctgaagggcgtgaagctgcactacacctga

SEQ ID NO: 23041 - RNA, 3822 nt, synthetic construct; identical to SEQ ID NO: 12034
  misc_feature 1..3822: note = SARS-CoV-2/Wuhan/WIV05/2019__EPI_ISL_402128 spike protein CDS gc mod (1-1273)
  source 1..3822: mol_type = other RNA

SEQ ID NO: 23042 - RNA, 3822 nt, synthetic construct
  misc_feature 1..3822: note = SARS-CoV-2/Wuhan/WIV05/2019__EPI_ISL_402128 spike protein CDS gc mod (1-1273)(D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23043 - RNA, 3822 nt, synthetic construct
  misc_feature 1..3822: note = SARS-CoV-2/Wuhan/WIV05/2019__EPI_ISL_402128 spike protein CDS gc mod (1-1273)(A222V_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23044 - RNA, 3822 nt, synthetic construct
  misc_feature 1..3822: note = SARS-CoV-2/Wuhan/WIV05/2019__EPI_ISL_402128 spike protein CDS gc mod (1-1273)(N439K_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23045 - RNA, 3822 nt, synthetic construct
  misc_feature 1..3822: note = SARS-CoV-2/Wuhan/WIV05/2019__EPI_ISL_402128 spike protein CDS gc mod (1-1273)(S477N_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23046 - RNA, 3822 nt, synthetic construct
  misc_feature 1..3822: note = SARS-CoV-2/Wuhan/WIV05/2019__EPI_ISL_402128 spike protein CDS gc mod (1-1273)(N501Y_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23047 - RNA, 3816 nt, synthetic construct
  misc_feature 1..3816: note = SARS-CoV-2/Wuhan/WIV05/2019__EPI_ISL_402128 spike protein CDS gc mod (1-1273)(H69del_V70del_D614G)
  source 1..3816: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23048 - RNA, 3822 nt, synthetic construct
  misc_feature 1..3822: note = SARS-CoV-2/Wuhan/WIV05/2019__EPI_ISL_402128 spike protein CDS gc mod (1-1273)(Y453F_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23049 - RNA, 3822 nt, synthetic construct
  misc_feature 1..3822: note = SARS-CoV-2/Wuhan/WIV05/2019__EPI_ISL_402128 spike protein CDS gc mod (1-1273)(D614G_I692V)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23050 - RNA, 3822 nt, synthetic construct
  misc_feature 1..3822: note = SARS-CoV-2/Wuhan/WIV05/2019__EPI_ISL_402128 spike protein CDS gc mod (1-1273)(D614G_M1229I)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23051 - RNA, 3816 nt, synthetic construct
  misc_feature 1..3816: note = SARS-CoV-2/Wuhan/WIV05/2019__EPI_ISL_402128 spike protein CDS gc mod (1-1273)(H69del_V70del_A222V_Y453F_S477N_D614G_I692V)
  source 1..3816: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcaacaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23052 - RNA, 3816 nt, synthetic construct
  misc_feature 1..3816: note = SARS-CoV-2/Wuhan/WIV05/2019__EPI_ISL_402128 spike protein CDS gc mod (1-1273)(H69del_V70del_Y453F_D614G_I692V_M1229I)
  source 1..3816: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcgtgattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23053 - RNA, 3813 nt, synthetic construct
  misc_feature 1..3813: note = SARS-CoV-2/Wuhan/WIV05/2019__EPI_ISL_402128 spike protein CDS gc mod (1-1273)(H69del_V70del_Y144del_N501Y_A570D_D614G_P681H_T716 I_S982A_D1118H)
  source 1..3813: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccacagacgggctagaagcgtggccagccagagcatcattgcctacacaatgtctctgggcgccgagaacagcgtggcctactccaacaactctatcgctatccccatcaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23054 - RNA, 3822 nt, synthetic construct
  misc_feature 1..3822: note = SARS-CoV-2/Wuhan/WIV05/2019__EPI_ISL_402128 spike protein CDS gc mod (1-1273)(K417N_E484K_N501Y_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23055 - RNA, 3813 nt, synthetic construct
  misc_feature 1..3813: note = SARS-CoV-2/Wuhan/WIV05/2019__EPI_ISL_402128 spike protein CDS gc mod (1-1273)(L18F_D80A_D215G_L242del_A243del_L244del_R246I_K417 N_E484K_N501Y_D614G_A701V)
  source 1..3813: mol_type = other RNA
atgttcgtgtttctggtgctgctgcccctggtgtccagccagtgtgtgaacttcaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgccaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcggggcctgcctcagggcttctctgctctggaacccctggtggatctgcccatcggcatcaacatcacccggtttcagacactgcacatcagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgtggagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23056 - RNA, 3822 nt, synthetic construct
  misc_feature 1..3822: note = SARS-CoV-2/Wuhan/WIV05/2019__EPI_ISL_402128 spike protein CDS gc mod (1-1273)(E484K_D614G)
  source 1..3822: mol_type = other RNA
atgttcgtgtttctggtgctgctgcccctggtgtccagccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23057 - RNA, 3822 nt, synthetic construct
  misc_feature 1..3822: note = SARS-CoV-2/Wuhan/WIV05/2019__EPI_ISL_402128 spike protein CDS gc mod (1-1273)(L18F_T20N_P26S_D138Y_R190S_K417T_E484K_N501Y_D614G _H655Y_T1027I)
  source 1..3822: mol_type = other RNA
atgttcgtgtttctggtgctgctgcccctggtgtccagccagtgtgtgaacttcaccaacagaacacagctgcctagcgcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaactaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgagcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaccatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatcagcaccgaaatctatcaggccggcagcaccccttgcaacggcgtgaagggcttcaactgctacttcccactgcagtcctacggctttcagcccacatacggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccatcaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23058 - RNA, 3822 nt, synthetic construct
  misc_feature 1..3822: note = SARS-CoV-2/Wuhan/WIV05/2019__EPI_ISL_402128 spike protein CDS gc mod (1-1273)(S13I_W152C_L452R_D614G)
  source 1..3822: mol_type = other RNA
atgttcgtgtttctggtgctgctgcccctggtgtccatccagtgtgtgaacctgaccaccagaacacagctgcctccagcctacaccaacagcttcaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctgcatggaaagcgagttccgggtgtacagcagcgccaacaactgcaccttcgagtacgtgtcccagcctttcctgatggacctggaaggcaagcagggcaacttcaagaacctgcgcgagttcgtgttcaagaacatcgacggctacttcaaaatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattaccgctaccggctgttccggaagtccaatctgaagcccttcgagcgggacatcagcaccgaaatctatcaggccggcagcaccccttgcaacggcgtggaaggcttcaactgctacttcccactgcagtcctacggctttcagcccacaaatggcgtgggctatcagccctacagagtggtggtgctgagcttcgaactgctgcatgctcctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccatgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggcatctgtgccagctaccagacacagacaaacagccccagacgggctagaagcgtggccagccagagcatcattgcctacacaatgtctctgggcgccgagaacagcgtggcctactccaacaactctatcgctatccccaccaacttcaccatcagcgtgaccaccgagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcaaatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagctggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgttgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacctga

SEQ ID NO: 23059 - RNA, 3822 nt, synthetic construct
  misc_feature 1..3822: note = SARS-CoV-2/Wuhan/WIV05/2019__EPI_ISL_402128 spike protein CDS gc mod (1-1273)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23060 - RNA, 3822 nt, synthetic construct
  misc_feature 1..3822: note = SARS-CoV-2/Wuhan/WIV05/2019__EPI_ISL_402128 spike protein CDS gc mod (1-1273)(D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23061 - RNA, 3822 nt, synthetic construct
  misc_feature 1..3822: note = SARS-CoV-2/Wuhan/WIV05/2019__EPI_ISL_402128 spike protein CDS gc mod (1-1273)(A222V_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23062 - RNA, 3822 nt, synthetic construct
  misc_feature 1..3822: note = SARS-CoV-2/Wuhan/WIV05/2019__EPI_ISL_402128 spike protein CDS gc mod (1-1273)(N439K_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaagaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23063 - RNA, 3822 nt, synthetic construct
  misc_feature 1..3822: note = SARS-CoV-2/Wuhan/WIV05/2019__EPI_ISL_402128 spike protein CDS gc mod (1-1273)(S477N_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23064 - RNA, 3822 nt, synthetic construct
  misc_feature 1..3822: note = SARS-CoV-2/Wuhan/WIV05/2019__EPI_ISL_402128 spike protein CDS gc mod (1-1273)(N501Y_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23065 - RNA, 3816 nt, synthetic construct
  misc_feature 1..3816: note = SARS-CoV-2/Wuhan/WIV05/2019__EPI_ISL_402128 spike protein CDS gc mod (1-1273)(H69del_V70del_D614G)
  source 1..3816: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23066 - RNA, 3822 nt, synthetic construct
  misc_feature 1..3822: note = SARS-CoV-2/Wuhan/WIV05/2019__EPI_ISL_402128 spike protein CDS gc mod (1-1273)(Y453F_D614G)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23067 - RNA, 3822 nt, synthetic construct
  misc_feature 1..3822: note = SARS-CoV-2/Wuhan/WIV05/2019__EPI_ISL_402128 spike protein CDS gc mod (1-1273)(D614G_I692V)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23068 - RNA, 3822 nt, synthetic construct
  misc_feature 1..3822: note = SARS-CoV-2/Wuhan/WIV05/2019__EPI_ISL_402128 spike protein CDS gc mod (1-1273)(D614G_M1229I)
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23069 - RNA, 3816 nt, synthetic construct
  misc_feature 1..3816: note = SARS-CoV-2/Wuhan/WIV05/2019__EPI_ISL_402128 spike protein CDS gc mod (1-1273)(H69del_V70del_A222V_Y453F_S477N_D614G_I692V)
  source 1..3816: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgtgctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcaacaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23070 - RNA, 3816 nt, synthetic construct
  misc_feature 1..3816: note = SARS-CoV-2/Wuhan/WIV05/2019__EPI_ISL_402128 spike protein CDS gc mod (1-1273)(H69del_V70del_Y453F_D614G_I692V_M1229I)
  source 1..3816: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgttccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcgtgattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatcgtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 23071 - RNA, 3813 nt, synthetic construct
  misc_feature 1..3813: note = SARS-CoV-2/Wuhan/WIV05/2019__EPI_ISL_402128 spike protein CDS gc mod (1-1273)(H69del_V70del_Y144del_N501Y_A570D_D614G_P681H_T716 I_S982A_D1118H)
  source 1..3813: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacatacggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgacgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccaccggagagccagaagcgtggccagccagagcatcattgcctacacaatgtctctgggcgccgagaacagcgtggcctactccaacaactctatcgctatccccatcaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctggccagactggacaaggtcgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccacccacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga
